US012781198B2

(12) United States Patent
Kruis et al.

(10) Patent No.: US 12,781,198 B2
(45) Date of Patent: Nov. 3, 2026

(54) GENETICALLY MODIFIED *METHYLOBACILLUS* BACTERIA HAVING IMPROVING PROPERTIES

(71) Applicant: Acies Bio d.o.o., Ljubljana (SI)

(72) Inventors: Aleksander Johannes Kruis, Bled (SI); David Virant, Dob (SI); Jaka Horvat, Kranj (SI); Toni Nagode, Ljubljana (SI); Štefan Fujs, Ljubljana (SI)

(73) Assignee: Acies Bio d.o.o., Ljubljana (SI)

( * ) Notice: Subject to any disclaimer, the term of this patent is extended or adjusted under 35 U.S.C. 154(b) by 636 days.

(21) Appl. No.: 18/029,273

(22) PCT Filed: Sep. 30, 2021

(86) PCT No.: PCT/EP2021/076963
§ 371 (c)(1),
(2) Date: Mar. 29, 2023

(87) PCT Pub. No.: WO2022/069644
PCT Pub. Date: Apr. 7, 2022

(65) Prior Publication Data

US 2023/0365977 A1 Nov. 16, 2023

(30) Foreign Application Priority Data

Oct. 2, 2020 (EP) .................................... 20199856

(51) Int. Cl.
*C12N 9/00* (2006.01)
*C12N 1/32* (2006.01)
(Continued)

(52) U.S. Cl.
CPC ................ *C12N 9/00* (2013.01); *C12N 1/32* (2013.01); *C12N 9/1048* (2013.01); *C12N 9/12* (2013.01);
(Continued)

(58) Field of Classification Search
CPC .......... C12N 9/00; C12N 9/1048; C12N 9/12; C12N 9/90
See application file for complete search history.

(56) References Cited

U.S. PATENT DOCUMENTS

2007/0245425 A1 10/2007 Brugiere
2024/0018559 A1 1/2024 Kogej et al.
2025/0263731 A1 8/2025 Kruis et al.

FOREIGN PATENT DOCUMENTS

JP 11-15499 A 1/1999
JP 2003-159073 A 6/2003
(Continued)

OTHER PUBLICATIONS

CP000284.1. GenBank Database. Mfla_1268 to Mfla_1280 and Mfla_2007 to Mfla_2029. Jul. 25, 2017 (Year: 2017).*
(Continued)

*Primary Examiner* — Yong D Pak
(74) *Attorney, Agent, or Firm* — Knobbe, Martens, Olson & Bear, LLP

(57) ABSTRACT

The present invention generally relates to the biotechnology engineering, and specifically to genetically modified bacteria of the genus *Methylobacillus* which have improved properties making them particularly useful in large scale methanol fermentations. More specifically, the present invention provides a bacterium of the genus *Methylobacillus* which has been modified to have a decreased production of exopolysaccharides (EPS) compared to an otherwise identical bacterium that does not carry said modification. The present invention further provides a method for producing a biochemical compound using a genetically modified bacterium of the present invention.

11 Claims, 3 Drawing Sheets

Specification includes a Sequence Listing.

(51) Int. Cl.

| | |
|---|---|
| ***C12N 9/10*** | (2006.01) |
| ***C12N 9/12*** | (2006.01) |
| ***C12N 9/90*** | (2006.01) |
| ***C12N 15/52*** | (2006.01) |

(52) U.S. Cl.

CPC ............... *C12N 9/90* (2013.01); *C12N 15/52* (2013.01); *C12Y 501/01016* (2013.01)

(56) References Cited

FOREIGN PATENT DOCUMENTS

| | | | |
|---|---|---|---|
| JP | 2009-153382 | A | 7/2009 |
| WO | WO 2002/072818 | | 7/2004 |
| WO | WO 2014/205146 | A1 | 12/2014 |
| WO | WO 2015/133590 | | 9/2015 |
| WO | WO 2015/155790 | A2 | 10/2015 |
| WO | WO 2016/044655 | | 3/2016 |
| WO | WO 2016/183413 | A1 | 11/2016 |
| WO | WO 2014/066670 | A1 | 5/2024 |

OTHER PUBLICATIONS

Ayabe-Chujo, Yuko et al., "Membrane Topology and Functional Analysis of Methylobacillus sp. 12S Genes epsF and epsG, Encoding Polysaccharide Chain-Length Determining Proteins" Bioscience Biotechnology Biochemistry, 2012, pp. 608-612, vol. 76, No. 3.

Chistoserdova, Ludmila et al., "Genome of Methylobacillus flagellatus, Molecular Basis for Obligate Methylotrophy, and Polyphyletic Origin of Methylotrophy" Journal of Bacteriology, Jun. 2007, pp. 4020-4027, vol. 189, No. 11.

Copeland, A. et al., "Methylobacillus flagellates KT, complete genome" GenBank: CP000284.1, May 23, 2006.

Datsenko, Kirill A. et al., "One-step inactivation of chromosomal genes in *Escherichia coli* K-12 using PCR products" PNAS, Jun. 2000, pp. 6640-6645, vol. 97, No. 12.

Kwon, Dong H. et al., "Frameshift mutations in rdxA and metronidazole resistance in North American Helicobacter pylori isolates" Journal of Antimicrobial Chemotherapy, 2000, pp. 793-796, vol. 46.

Hattori, M. et al. (2020) "Methylobacillus glycogenes JCM 2850" whole genome shotgun sequencing p—Nucleotide—NCBI—ASM61792v1.

Qiu, Zhihao et al., "The *Escherichia coli* polB Locus Is Identical to dinA, the Structural Gene for DNA Polymerase II" The Journal of Biological Chemistry, Mar. 1997, pp. 8611-8617, vol. 272, No. 13.

Yoshida, T. et al., "Saccharide production from methanol by transposon 5 mutants derived from the extracellular polysaccharide-producing bacterium *Methylobacillus* sp. strain 12S" Appl Microbiol Bioteclmol, 2000, pp. 341-347, vol. 54.

Yoshida, Takako et al., "Genes involved in the synthesis of the exopolysaccharide methanolan by the obligate methylotroph *Methylobacillus* sp. strain 12S" Microbiology, 2003, pp. 431-444, vol. 149.

Anonymous "UniParc—UPI0000D5AA38" Apr. 14, 2006—XP055782862—URL:https://www.uniprot.org/uniparc/UPI0000D5AA38.

Anonymous "UniParc—UPI00046F5699" Jun. 6, 2014—XP055782890—URL:https://www.uniprot.org/uniparc/UPI00046F5699.

Anonymous "UniParc—UPI000470EOB4" Jun. 6, 2014—XP05578289—URL:https://www.uniprot.org/uniparc/UPI000470E0B4.

Anonymous "UniParc—UPI0000543E2D" Jun. 27, 2006—XP055782872—URL:https://www.uniprot.org/uniparc/UPI0000543E2D.

Anonymous "UniParc—UPI0004719B41" Jun. 6, 2014—XP055782897—URL:https://www.uniprot.org/uniparc/UPI0004719B41.

Anonymous "UniParc—UPI00005415B8" Jun. 27, 2006—XP055782879—URL:https://www.uniprot.org/uniparc/UPI00005415B8.

Anonymous "UniParc—UPI000054202D" Jun. 27, 2006—XP055782874—URL:https://www.uniprot.org/uniparc/UPI000054202D.

Anonymous "UniParc—UPI0004707552" Jun. 6, 2014—XP055782892—URL:https://www.uniprot.org/uniparc/UPI0004707552.

European Search Report for EP 20199856 dated Mar. 8, 2021.

International Search Report for PCT/EP2021/076963 dated Jan. 26, 2022.

Office Action for JP 2023-520127 issued May 27, 2025.

Akiyoshi et al., "Cloning and nucleotide sequence of the tzs gene from *Argobacterium tumefaciens* strain T37", Nucleic Acids Research, vol. 13(8):2773-2788 (1985).

Akiyoshi et al., "Cytokinin production by Argobacterium and *Pseudomonas spp.*", Journal of Bacteriology, vol. 169(9):4242-4248 (1987).

Arkhipova et al., "Ability of bacterium *Bacillus subtilis* to produce cytokinins and to influence the growth and endogenous hormone content of lettuce plants", Plant and Soil, vol. 272:201-209 (2005).

Asahara et al., "Accumulation of gene-targeted *Bacillus subtilis* mutations that enhance fermentative inosine production", Appl Microbiol Biotechnol, vol. 87:2195-2207 (2010).

Ashihara et al., "Purine salvage in plants", Pharmacology & Therapeutics, vol. 88(3):349-425 (2000).

Banerjee et al., "Feedback inhibition of deoxy-D-xylulose-5-phosphate synthase regulates the methylerythritol 4-phosphate pathway", The Journal of Biological Chemistry, vol. 288(23):16926-16936 (2013).

Barry, G.F. et al., "Identification of a cloned cytokinin biosynthetic gene" Proc. Natl. Acad. Sci., Aug. 1984, pp. 4776-4780, vol. 81.

Camas-Reyes et al., "*E. Coli* cultures expressing a synthetic sequence of ptz gene (stz) promoted in vitro direct organogenesis in Nicotiana Tabacum L.", Plant Cell, Tissue and Organ Culture vol. 137:87- 100 (2019).

Chen et al., "Mechanism of the synergistic end-product regulation of Bacillus subtilis glutamine phosphoribosylpyrophosphate amidotransferase by nucleotides", Biochemistry, vol. 36:10718-10726 (1997).

Christiansen et al., Xanthine metabolism in *Bacillus subtilis*: Characterization of the xpt-pbuX operon and evidence for purine- and nitrogen-controlled expression of genes involved in xanthine salvage and catabolism', Journal of Bacteriology, vol. 179(8):2540-2550 (1997).

Frebort et al., "Evolution of cytokinin biosynthesis and degradation", Journal of Experimental Botany, vol. 62(8):2431-2452 (2011).

Frebortova et al., "Biochemical characterization of putative adenylate dimethylallyltransferase and cytokinin dehydrogenase from Nostoc sp. PCC 7120", Plos One, vol. 10(9):1-21 (2015).

GenBank Database, AAB72065, Jul. 24, 2016.

GenPept Database, Inosine-monophosphate dehydrogenase [*Bacillus subtilis* subsp. Subtilis str. 168], NP_387890, Sep. 18, 2018, in 3 pages.

GenPept Database, NP_388517, Sep. 18, 2018, in 3 pages.

GenPept Database, 034443, Apr. 10, 2019, in 2 pages.

Guo, Wei et al., "Genome-scale revealing the central metabolic network of the fast growing methanotroph Methylomonas sp. ZR1" World Journal of Microbiology and Biotechnology, 2021, pp. 1-17, vol. 37, No. 29.

He, Guoren et al., "Mechanism of exogenous cytokinins inducing bulbil formation in Lilium lancifolium in vitro" Plant Cell Reports, 2020, pp. 861-872, vol. 39.

Hecht, "Enzyme-assisted preparation of isotope-labeled 1-deoxy-d-xylulose 5-phosphate", J. Org. Chem., vol. 66(11):3948-3952 (2001).

Henke et al., "Improved plasmid-based inducible and constitutive gene expression in *Corynebacterium glutamicum*", Microorganisms, vol. 9(204):1-15 (2021).

Ishii et al., "Regulation of purine nucleotide biosynthesis in *Bacillus subtilis*", Agr. Biol. Chem., vol. 37(2):287-300 (1973).

(56) References Cited

OTHER PUBLICATIONS

Julsing et al., "Functional analysis of genes involved in the biosynthesis of isoprene in *Bacillus subtilis*", Applied Genetics and Molecular Biotechnology, vol. 75:1377-1384 (2007).
Kakimoto, "Identification of plant cytokinin biosynthetic enzymes as dimethylallyl diphosphate: ATP/ADP isopentenyltransferases", Plant Cell Physiol., vol. 42(7):677-685 (2001).
Kakimoto, "Biosynthesis of cytokinins", J. Plant. Res., vol. 116:233-239 (2003).
Kamada-Nobusada et al., "Molecular basis for cytokinin biosynthesis", Phytochemistry, vol. 70:444- 449 (2009).
Kieber, Joseph J. et al., "Cytokinins" The Arabidopsis Book, Jan. 2014, pp. 1-35, vol. 12.
Konishi et al., "Fermentative production of guanosine by 8-azaguanine resistant of *Bacillus subtilis*; ", Biol. Chem. vol. 32(3):396-398 (1968).
Kurakawa et al., "Direct control of shoot meristem activity by a cytokinin-activating enzyme", Nature Letters, vol. 445:652-655 (2007).
Kuzuyama et al., "Cloning and characterization of 1-deoxy-$_D$-xylulose 5-phosphate synthase from *Streptomyces sp.* Strain CL190, which uses both the mevalonate and nonmevalonate pathways for isopentenyl diphosphate biosynthesis", Journal of Bacteriology, vol. 182(4):891-897 (2000).
Kuzuyama et al., "Two distinct pathways for essential metabolic precursors for isoprenoid biosynthesis", Proc. Jpn. Acad., Ser. B, vol. 88(3):41-52 (2012).
Li, Si-Min et al., "Cytokinins as central regulators during plant growth and stress response" Plant Cell Reports, 2021, pp. 271-282, vol. 40.
Li et al., "Increased fermentative adenosine production by gene-targeted *Bacillus subtilis* mutation", Journal of Biotechnology, vol. 298:1-4 (2019).
Liu et al., "Introduction of marker-free deletion in *Bacillus subtilis* using AraR repressor and the ara promoter", Microbiology, 154(9):2562-2570 (2008).
Ma, Qing-Hu "Genetic Engineering of Cytokinins and Their Application to Agriculture" Critical Reviews in Biotechnology, 2008, pp. 213-232, vol. 28.
Mok et al., "Cytokinins: Biosynthesis, metabolism and perception", In Vitro Cell. Dev. Biol. —Plant, vol. 36:102-107 (2000).
Nishii et al., "Tangled history of a multigene family: The evolution of *ISOPENTENYLTRANSFERASE* genes", PLoS One, vol. 13(8):1-23 (2018).
Patel et al., "Isolation, purification and estimation of Zeatin from *Corynebacterium aurimucosum*", European Journal of Experimental Biology, vol. 2(1) 1-8 (2012).
Peifer et al., "Metabolic engineering of the purine biosynthetic pathway in *Cornebacterium glutamicum* results in increased intracellular pool sizes of IMP and hypoxanthine", Microbial Cell Factories, vol. 11(138):1-14 (2012).
Powell et al., "Nucleotide sequence and expression of a Pseudomonas savastanoi cytokinin biosynthetic gene: homology with Agrobacterium fumefaciens tmr and tzs loci", Nucleic Acids Research, vol. 14(6):2555-2565 (1986).
Regier et al., "Secretion of Trans-zeatin by *Agrobacterium tumefaciens*: A function determined by the nopaline TI plasmid", Biochemical and Biophysical Research Communications, vol. 104(4):1560-1566 (1982).
Ruan et al., "Improving the electro-transformation efficiency of *Corynebacterium glutamicum* by weakening its cell wall and increasing the cytoplasmic membrane fluidity", Biotechnol Lett, published online Sep. 9, 2015, doi:10.1007/s10529-015-1934-x.
Sakakibara et al., "*Agrobacterium tumefaciens* increases cytokinin production in plastids by modifying the biosynthetic pathway in the host plant", PNAS, vol. 102(28):9972-9977 (2005).
Sakakibara, "Cytokinins: Activity, biosynthesis, and translocation", Annu. Rev. Plant Biol. Vol. 57:431-49 (2006).
Sakakibara, "Cytokinin biosynthesis and regulation", Vitamins and Hormones, vol. 72:271-287 (2005).
Scarbrough et al., "Isolation of cis-Zeatin from *Corynebacterium fascians* cultures", Proc. Nat. Acad. Sci. Vol. 70(12 Part II):3825-3829 (1973).
Schafer et al., "The role of cis-zeatin-type cytokinins in plant growth regulation and mediating responses to environmental interactions", J Exp Bot, vol. 66(16):4873-4884 (2015).
Schumann, "Production of recombinant proteins in *Bacillus subtilis*", Adv. Appl. Microbiol., vol. 62:137-139 (2007).
Seo et al., "Structural basis for cytokinin production by LOG from *Corynebacterium glutamicum*", Scientific Reports, vol. 6:31390, pp. 1-9 (2016).
Seo et al., "Structural basis for a novel type of cytokinin-activating protein", Scientific Reports, vol. 7:45985, pp. 1-14 (2017).
Shi et al., "Deregulation of purine pathway in *Bacillus subtilis* and its use in riboflavin biosynthesis", Microbial Cell Factories, vol. 13:101 (2014).
Shi et al., "Transcriptome analysis guided metabolic engineering of Bacillus subtilis for riboflavin production", Metabolic Engineering, vol. 11:243-252 (2009).
Stirk et al., "Flow of cytokinins through the environment", Plant Growth Regul, vol. 62:101-116 (2010).
Streletskii et al., "Yeasts producing zeatin", PeerJ, Doi 10.7717/PEERJ.6474:1-16 (2019).
Sugawara et al., "Structural insight into the reaction mechanism and evolution of cytokinin biosynthesis", PNAS, vol. 105(7):2734-2739 (2008).
Takei et al., "Identification of genes encoding adenylate isopentenyltransferase, a cytokinin biosynthesis enzyme, in *Arabidopsis thaliana*", The Journal of Biological Chemistry, vol. 276(28):26405-26410 (2001).
Takei et al., "Arabidopsis CYP735A1 and CYP735A2 encode cytokinin hydroxylases that catalyze the biosynthesis of trans-Zeatin", The Journal of Biological Chemistry, vol. 279(40):41866-41872 (2004).
UniProtKB/Swiss-Prot Database, P46373, May 8, 2019, in 2 pages.
UniProt/KB/TrEMBL Database, Q8NN34, Oct. 16, 2019, in 2 pages.
UniProtKB/Swiss-Prot Database, P58592, May 8, 2019, in 2 pages.
Wang et al., "Enhancement of riboflavin production with *Bacillus subtilis* by expression and site-directed mutagenesis of zwf and gnd gene from *Corynebacterium glutamicum*", Bioresource Technology, vol. 102:3934-3940 (2011).
Wang et al., "Directed evolution of adenylosuccinate synthetase from *Bacillus subtilis* and its application in metabolic engineering", Journal of Biotechnology, vol. 231:115-121 (2016).
Xiang et al., "Crystal structure of 1-Deoxy-D-xylulose 5-phosphate synthase, a crucial enzyme for isoprenoids biosynthesis", The Journal of Biological Chemistry, vol. 282(4):2676-2682 (2007).
Xiang et al., "1-deoxy-D-xylulose 5-phosphate synthase (DXS), a crucial enzyme for isoprenoids biosynthesis", Isoprenoid Synthesis in Plants and Microorganisms: New Concepts and Experimental Approaches, DOI 10.1007/978-1-4614-4063-5_2, pp. 17-28 (2013).
Xue et al., "Enhanced C30 carotenoid production in *Bacillus subtilis* by systematic overexpression of MEP pathway genes", Appl Microbiol Biotechnol, vol. 99:5907-5915 (2015).
Yang et al., "Modular pathway engineering of *Bacillus subtilis* to promote De Novo biosynthesis of menaquinone-7", ACS Synthetic Biology, vol. 8:70-81 (2019).
Yeh, Chuan-Shan et al., "Molecular characterization of isopentenyltransferase (BoAIPT1) from Bambusa oldhamii expressed in *Escherichia coli*" Botanical Studies, 2011, pp. 249-256, vol. 52.
Zakataeva et al., "Wild-type and feedback-resistant phosphoribosyl pyrophosphate synthetases from *Bacillus amyloliquefaciens*: purification, characterization, and application to increase purine nucleoside production", Appl Microbiol Biotechnol, vol. 93:2023-2033 (2012).
Zeigler et al., "The origins of 168, W23, and other *Bacillus subtilis* legacy strains", vol. 190(21):6983-6995 (2008).
Zhang et al., "Adenine phosphoribosyl transferase 1 is a key enzyme catalyzing cytokinin conversion from nucleobases to nucleotides in arabidopsis", Molecular Plant, vol. 6(5):1661-1672 (2013).
European Search Report for EP 20075015 dated May 5, 2021.
International Search Report for PCT/EP2021/083188 dated Mar. 4, 2022.

(56) References Cited

OTHER PUBLICATIONS

Office Action in Japanese application No. 2023-532104, dated Dec. 5, 2025, in 8 pages.
European Search Report for EP 22169245 dated Nov. 22, 2022.
International Search Report for PCT/EP2023/060503 dated Aug. 8, 2023.

* cited by examiner

GENETICALLY MODIFIED *METHYLOBACILLUS* BACTERIA HAVING IMPROVING PROPERTIES

CROSS REFERENCE TO RELATED APPLICATIONS

This application is a U.S. National Phase Application of PCT International Application Number PCT/EP2021/076963, filed on Sep. 30, 2021, designating the United States of America and published in the English language, which is an International Application of and claims the benefit of priority to European Patent Application No. 20199856.4, filed on Oct. 2, 2020. The disclosures of the above-referenced applications are hereby expressly incorporated by reference in their entireties.

REFERENCE TO SEQUENCE LISTING

A Sequence Listing submitted as an ASCII text file via EFS-Web is hereby incorporated by reference in accordance with 37 U.S.C. § 1.52 (e). The name of the ASCII text file for the Sequence Listing is SeqList-ZACC262-001APC.txt, the date of creation of the ASCII text file is Mar. 1, 2023, and the size of the ASCII text file is 663,518 bytes.

TECHNICAL FIELD OF THE INVENTION

The present invention generally relates to the biotechnology engineering, and specifically to genetically modified bacteria of the genus *Methylobacillus* which have improved properties making them particularly useful in large scale methanol fermentations. More specifically, the present invention provides a bacterium of the genus *Methylobacillus* which has been modified to have a decreased production of exopolysaccharides (EPS) compared to an otherwise identical bacterium that does not carry said modification. The present invention further provides a method for producing a biochemical compound using a genetically modified bacterium of the present invention.

BACKGROUND OF THE INVENTION

Methanol fermentation has the potential to replace oil-derived chemical production. To realize this, efficient methylotrophic (consuming one-carbon compounds such as methanol or methane or multi-carbon compounds that contain no carbon-carbon bonds) strains must be developed. Several bacteria capable of utilizing methanol as the sole source of carbon for growth and product formation have been identified. Some examples include *Bacillus methanolicus, Methylobacterium extorquens, Methylobacillus glycogenes* and *Methylobacillus flagellatus*. Methylotrophic bacteria can be divided into two broad groups based on their methanol assimilation pathways. The first step is always the conversion of methanol into formaldehyde, catalyzed by a methanol dehydrogenase enzyme. In the first group, formaldehyde reacts with Ribulose-monophosphate (RuMP) to form C6-compounds that are then metabolized further. Members of this group are commonly referred to as "RuMP cycle methylotrophs". The second group, which includes M. extorquens, assimilate formaldehyde by reacting it with glycine, forming serine in the pathway known as the serine cycle. Both groups of methylotrophic bacteria have been used for the production of various biochemicals from methanol. However, the RuMP cycle is more energy efficient than the serine cycle, resulting in faster growth and biomass formation.

Methylotrophic microorganisms can be found in extremely diverse environments, such as oceans, soil, plant rhizosphere and even sewage water. Since they must be capable of surviving these diverse and often harsh environments, methylotrophic bacteria often tend to be quite robust and resistant to different types of stress, all while growing efficiently on minimal nutrients. Strains from the RuMP cycle-utilizing *Methylobacillus* genus possess a number of traits desired in biochemical productions trains; they grow rapidly and reproducibly in minimal mineral media and they are insensitive to fluctuations in temperature and methanol concentration. Furthermore, they are very amenable to genetic manipulation, unlocking the potential for metabolic engineering of complex pathways.

Many methylotrophs, including *Methylobacilli* produce large amounts of exopolysaccharides (EPS), which confer multiple advantages to the organisms in their natural environment, such as protection from dessication, biofilm scaffold formation, energy reserves etc. In fed-batch fermentations, Mehtylobacillus biomass can consist of up to 30% EPS.

EPS production in *Methylobacilli* specifically is relatively unstudied. Research has only been performed on a single strain, *Methylobacillus* sp. strain 12S, an obligate methylotroph isolated from soil, which was found to synthesize a novel EPS termed methanolan (Yoshida et al., 2000). While the gene cluster responsible for methanolan synthesis in *Methylobacillus* sp. strain 12S has been identified and characterized (Yoshida et al., 2003), no such work has been done in other *Methylobacilli*. Based on bioinformatic analysis and sequence similarities, an EPS gene cluster has been predicted in *Methylobacillus flagellatus* strain KT (Chistoserdova et al., 2007) and *Methylobacillus glycogenes* (Hattori et al., 2020), though the genes themselves have never been characterized.

SUMMARY OF THE INVENTION

The object of the present invention is to overcome certain drawbacks in methanol-based bioprocesses. This is achieved by the present inventors who have engineered different genetically modified bacteria of the genus *Methylobacillus* having a decreased production of exopolysaccharides (EPS).

The present inventors studied general EPS production in *Methylobacilli*. Based on bioinformatic analysis of the genome of *M. flagellatus* and *M. glycogenes*, the present inventors identified two putative EPS-producing gene clusters. Disruption of both EPS clusters resulted in complete abolishment of EPS production.

An unexpected and surprising observation in the modified *M. flagellatus* and *M. glycogenes* strains was their behavior in growth cultures. When abolishing the expression of one or more endogenous polypeptides involved in the production of exopolysaccharides (EPS) in the *Methylobacillus* bacteria, the culture showed a number of surprising and unexpected properties beneficial to the development of methanol-based bioprocesses. Unexpectedly, the excessive culture foaming in both shake flasks and bioreactors was reduced. Moreover, while cell clumping was observed for unmodified parent strains, this was reduced or even absent in the culture of modified *Methylobacilli*. Centrifugation and filtration of the biomass was also improved when EPS production was eliminated. These combined characteristics significantly improve the bioprocess, strain handling, and downstream processing, making modified *Methylobacillus* bacteria suitable for large-scale methanol fermentations. Removal of EPS synthesis unexpectedly also improved the methanol tolerance of *M. flagellatus* and other *Methylobacillus* species.

Based on the foregoing finds, the present invention provides in a first aspect a genetically engineered bacterium of the genus *Methylobacillus* which has been modified to have a decreased production of exopolysaccharides (EPS) compared to an otherwise identical bacterium that does not carry said modification.

The present invention further provides a method for the production of a biochemical compound comprising cultivating a bacterium of the present invention under suitable culture conditions in a culture medium comprising a reduced one-carbon compound, such as methanol, or a multi-carbon compound that contains no carbon-carbon bonds, such as dimethylamine.

The present invention may be summarized by the following items:

1. A genetically engineered bacterium of the genus *Methylobacillus* which has been modified to have a decreased production of exopolysaccharides (EPS) compared to an otherwise identical bacterium that does not carry said modification.
2. The bacterium according to item 1, which has been modified to have a decreased expression and/or function (e.g. activity) of at least one endogenous polypeptide involved in the production of exopolysaccharides (EPS) in said bacterium compared to an otherwise identical bacterium that does not carry said modification (reference bacterium).
3. The bacterium according to item 1 or 2, which has been modified to have a decreased expression of at least one endogenous polypeptide involved in the production of exopolysaccharides (EPS) in said bacterium compared to an otherwise identical bacterium that does not carry said modification (reference bacterium).
4. The bacterium according to any one of items 1 to 3, which has been modified to have a decrease expression of at least two endogenous polypeptides involved in the production of exopolysaccharides (EPS) in said bacterium compared to an otherwise identical bacterium that does not carry said modification (reference bacterium).
5. The bacterium according to any one of items 1 to 4, which has been modified to have a decrease expression of at least three endogenous polypeptides involved in the production of exopolysaccharides (EPS) in said bacterium compared to an otherwise identical bacterium that does not carry said modification (reference bacterium).
6. The bacterium according to any one of items 1 to 5, which has been modified to have a decrease expression of at least four endogenous polypeptides involved in the production of exopolysaccharides (EPS) in said bacterium compared to an otherwise identical bacterium that does not carry said modification (reference bacterium).
7. The bacterium according to any one of items 1 to 6, which has been modified to have a decrease expression of at least five endogenous polypeptides involved in the production of exopolysaccharides (EPS) in said bacterium compared to an otherwise identical bacterium that does not carry said modification (reference bacterium).
8. The bacterium according to any one of items 1 to 7, which has been modified to have a decrease expression of at least six endogenous polypeptides involved in the production of exopolysaccharides (EPS) in said bacterium compared to an otherwise identical bacterium that does not carry said modification (reference bacterium).
9. The bacterium according to any one of items 1 to 8, which has been modified to have a decrease expression of all endogenous polypeptides involved in the production of exopolysaccharides (EPS) in said bacterium compared to an otherwise identical bacterium that does not carry said modification (reference bacterium).
10. The bacterium according to any one of items 2 to 9, wherein the at least one polypeptide involved in the production of exopolysaccharides (EPS) in said bacterium is selected from the group consisting of a) polypeptides comprising an amino acid sequence set forth in any one of SEQ ID NO: 1 to 38 and b) polypeptides comprising an amino acid sequence having at least 70% sequence identity with any one of SEQ ID NO: 1 to 38 and having the same functional property as the reference polypeptide.
11. The bacterium according to any one of items 2 to 10, wherein the at least one polypeptide involved in the production of exopolysaccharides (EPS) in said bacterium is selected from the group consisting of a) polypeptides comprising an amino acid sequence set forth in any one of SEQ ID NO: 1 to 26 and b) polypeptides comprising an amino acid sequence having at least 70% sequence identity with any one of SEQ ID NO: 1 to 26 and having the same functional property as the reference polypeptide.
12. The bacterium according to any one of items 2 to 10, wherein the at least one polypeptide involved in the production of exopolysaccharides (EPS) in said bacterium is selected from the group consisting of a) polypeptides comprising an amino acid sequence set forth in any one of SEQ ID NO: 27 to 38 and b) polypeptides comprising an amino acid sequence having at least 70% sequence identity with any one of SEQ ID NO: 27 to 38 and having the same functional property as the reference polypeptide.
13. The bacterium according to any one of items 2 to 12, wherein the at least one polypeptide involved in the production of exopolysaccharides (EPS) in said bacterium is selected from the group consisting of a) polypeptides comprising an amino acid sequence set forth in any one of SEQ ID NO: 39 to 86 and b) polypeptides comprising an amino acid sequence having at least 70% sequence identity with any one of SEQ ID NO: 39 to 86 and having the same functional property as the reference polypeptide.
14. The bacterium according to any one of items 2 to 13, wherein the at least one polypeptide involved in the production of exopolysaccharides (EPS) in said bacterium is selected from the group consisting of a) polypeptides comprising an amino acid sequence set forth in any one of SEQ ID NO: 39 to 60 and b) polypeptides comprising an amino acid sequence having at least 70% sequence identity with any one of SEQ ID NO: 39 to 60 and having the same functional property as the reference polypeptide.
15. The bacterium according to any one of items 2 to 13, wherein the at least one polypeptide involved in the production of exopolysaccharides (EPS) in said bacterium is selected from the group consisting of a) polypeptides comprising an amino acid sequence set forth in any one of SEQ ID NO: 61 to 86 and b) polypeptides comprising an amino acid sequence having at least 70% sequence identity with any one of SEQ ID NO: 61 to 86 and having the same functional property as the reference polypeptide.

16. The bacterium according to any one of items 2 to 15, wherein the at least one polypeptide involved in the production of exopolysaccharides (EPS) in said bacterium is selected from the group consisting a polypeptide having peptidyl-prolyl cis-trans isomerase activity, a polypeptide capable of acting as a polysaccharide exporter; a polypeptide acting as a chain length determinant protein; and a polypeptide having protein-tyrosine kinase activity.
17. The bacterium according to item 16, wherein the polypeptide having peptidyl-prolyl cis-trans isomerase activity comprises an amino acid sequence having at least 70% sequence identity to SEQ ID NO: 6, the polypeptide capable of acting as a polysaccharide exporter comprises an amino acid sequence having at least 70% sequence identity to SEQ ID NO: 7, the polypeptide acting as a chain length determinant protein comprises an amino acid sequence having at least 70% sequence identity to SEQ ID NO: 8 and the polypeptide having protein-tyrosine kinase activity comprises an amino acid sequence having at least 70% sequence identity to SEQ ID NO: 9.
18. The bacterium according to item 16, wherein the polypeptide having peptidyl-prolyl cis-trans isomerase activity comprises an amino acid sequence having at least 70% sequence identity to SEQ ID NO: 42, the polypeptide capable of acting as a polysaccharide exporter comprises an amino acid sequence having at least 70% sequence identity to SEQ ID NO: 43, the polypeptide acting as a chain length determinant protein comprises an amino acid sequence having at least 70% sequence identity to SEQ ID NO: 44 and the polypeptide having protein-tyrosine kinase activity comprises an amino acid sequence having at least 70% sequence identity to SEQ ID NO: 45.
19. The bacterium according to any one of items 2 to 18, wherein the expression of the at least one polypeptide involved in the production of exopolysaccharides (EPS) in said bacterium is decreased by at least 50%, such as by at least 60%, at least 65%, at least 70%, at least 75%, at least 80%, at least 85%, at least 90%, at least 95% or at least 100% compared to the otherwise identical bacterium.
20. The bacterium according to any one of items 2 to 19, wherein the expression of the at least one polypeptide involved in the production of exopolysaccharides (EPS) in said bacterium is abolished compared to the otherwise identical bacterium.
21. The bacterium according to any one of items 2 to 20, wherein the endogenous gene/s encoding said polypeptide/s involved in the production of exopolysaccharides (EPS) in said bacterium has/have been inactivated.
22. The bacterium according to any one of items 2 to 21, wherein the endogenous gene/s encoding said polypeptides/s involved in the production of exopolysaccharides (EPS) in said bacterium has/have been inactivated by deletion of part of or the entire gene sequence.
23. The bacterium according to any one of items 2 to 22, wherein the endogenous gene/s encoding said polypeptide/s involved in the production of exopolysaccharides (EPS) in said bacterium has/have been inactivated by introducing or expressing in the bacterium a respective rare-cutting endonuclease able to selectively inactivating by DNA cleavage the endogenous gene encoding said polypeptide.
24. The bacterium according to item 23, wherein said rare-cutting endonucleases are selected from the group consisting of a transcription activator-like effector (TALE) nuclease, meganuclease, zing-finger nuclease (ZFN) and RNA-guided endonuclease.
25. The bacterium according to item 24, wherein the RNA-guided endonuclease is a catalytically inactive Cas9 protein.
26. The bacterium according to item 25, which comprises (e.g., expresses) at least one single guide RNA (sgRNA) specifically hybridizing (e.g. binding) under cellular conditions with the genomic DNA encoding said enzyme(s).
27. The bacterium according to any one of items 2 to 21, wherein the expression of the polypeptide(s) involved in the production of exopolysaccharides (EPS) in said bacterium is decreased (e.g., inhibited) by transcriptional and/or translational repression of the endogenous gene(s) encoding said polypeptide(s).
28. The bacterium according to any one of items 2 to 21, wherein the expression of the polypeptide(s) involved in the production of exopolysaccharides (EPS) in said bacterium is decreased (e.g., inhibited) by introducing or expressing in the bacterium at least one inhibitory nucleic acid molecule that specifically hybridizes (e.g. binds) under cellular conditions with cellular mRNA and/or genomic DNA encoding said polypeptide(s).
29. The bacterium according to item 28, wherein the inhibitory nucleic acid molecule is an antisense oligonucleotide, ribozyme or interfering RNA (RNAi) molecule.
30. The bacterium according to item 29, wherein the interfering RNA molecule is a micro RNA (miRNA), small interfering RNA (siRNA) or short hairpin RNA (shRNA).
31. The bacterium according to any one of items 2 to 30, wherein the endogenous polypeptide or polypeptides involved in the production of exopolysaccharides (EPS) in said bacterium is/are encoded by a gene or genes included in a first EPS gene cluster and/or second EPS gene cluster.
32. The bacterium according to item 31, wherein the first EPS gene cluster includes genes defined by or orthologous to the open reading frames (ORFS) found in SEQ ID NO: 174 or 177.
33. The bacterium according to item 31 or 32, wherein the first EPS gene cluster includes the genes epsD, epsE, epsF, epsG, epsB, epsL, epsH, epsI, epsJ and epsS, or orthologs thereof.
34. The bacterium according to any one of items 31 to 33, wherein the first EPS gene cluster includes the genes epsD, epsE, epsF and epsG, or orthologs thereof.
35. The bacterium according to any one of items 31 to 34, wherein the first EPS gene cluster includes a nucleotide sequence which has at least 50% sequence identity with the nucleotide sequence of SEQ ID NO: 174 or 177.
36. The bacterium according to any one of items 31 to 34, wherein the first EPS gene cluster includes a nucleotide sequence which has at least 50% sequence identity with the nucleotide sequence of SEQ ID NO: 174.
37. The bacterium according to any one of items 31 to 36, wherein at least one gene in said first EPS gene cluster is inactivated, e.g., by deletion of part of or the entire gene sequence.

38. The bacterium according to any one of items 31 to 37, wherein at least one gene selected from epsD, epsE, epsF, epsG, epsB, epsL, epsH, epsI, epsJ and epsS, or ortholog thereof, is inactivated, e.g., by deletion of part of or the entire gene sequence.
39. The bacterium according to any one of items 31 to 38, wherein at least one gene selected from epsD, epsE, epsF and epsG, or ortholog thereof, is inactivated, e.g., by deletion of part of or the entire gene sequence.
40. The bacterium according to any one of items 31 to 39, wherein the genes epsD, epsE, epsF and epsG, or orthologs thereof, are inactivated, e.g., by deletion of part of or the entire gene sequence.
41. The bacterium according to item 39 or 40, wherein the gene epsD encodes a polypeptide comprising an amino acid sequence having at least 70% sequence identity to SEQ ID NO: 6, wherein the gene epsE encodes a polypeptide comprising an amino acid sequence having at least 70% sequence identity to SEQ ID NO: 7, wherein the gene epsF encodes a polypeptide comprising an amino acid sequence having at least 70% sequence identity to SEQ ID NO: 8, and wherein the gene epsG encodes a polypeptide comprising an amino acid sequence having at least 70% sequence identity to SEQ ID NO: 9.
42. The bacterium according to item 41, wherein the gene epsD comprises a nucleotide sequence having at least 70% sequence identity with SEQ ID NO: 92, the gene epsE comprises a nucleotide sequence having at least 70% sequence identity with SEQ ID NO: 93, the gene epsF comprises an nucleotide sequence having at least 70% sequence identity with SEQ ID NO: 94, and the gene epsG comprises an nucleotide sequence having at least 70% sequence identity with SEQ ID NO: 95.
43. The bacterium according to item 39 or 40, wherein the gene epsD encodes a polypeptide comprising an amino acid sequence having at least 70% sequence identity to SEQ ID NO: 42, wherein the gene epsE encodes a polypeptide comprising an amino acid sequence having at least 70% sequence identity to SEQ ID NO: 43, wherein the gene epsF encodes a polypeptide comprising an amino acid sequence having at least 70% sequence identity to SEQ ID NO: 44, and wherein the gene epsG encodes a polypeptide comprising an amino acid sequence having at least 70% sequence identity to SEQ ID NO: 45.
44. The bacterium according to item 43, wherein the epsD gene comprises a nucleotide sequence having at least 70% sequence identity with SEQ ID NO: 128, the gene epsE comprises a nucleotide sequence having at least 70% sequence identity with SEQ ID NO: 129, the gene epsF comprises an nucleotide sequence having at least 70% sequence identity with SEQ ID NO: 130, and the gene epsG comprises an nucleotide sequence having at least 70% sequence identity with SEQ ID NO: 131.
45. The bacterium according to any one of items 31 to 44, wherein the first EPS gene cluster is inactivated.
46. The bacterium according to any one of items 31 to 45, wherein the first EPS gene cluster is inactivated by deletion of part of or the entire sequence of said cluster.
47. The bacterium according to any one of items 31 to 45, wherein the first EPS gene cluster is inactivated by modification of (e.g., by introducing at least one mutation in) the promoter and/or ribosome binding site region resulting in the lack of gene expression.
48. The bacterium according to any one of items 31 to 47, wherein the second EPS gene cluster includes genes defined by or orthologous to the open reading frames (ORFS) found in SEQ ID NO: 175 or 179.
49. The bacterium according to any one of items 31 to 48, wherein the second EPS gene cluster includes a nucleotide sequence which has at least 50% sequence identity with the nucleotide sequence of 175 or 179.
50. The bacterium according to any one of items 31 to 48, wherein the second EPS gene cluster includes a nucleotide sequence which has at least 50% sequence identity with the nucleotide sequence of 175.
51. The bacterium according to any one of items 31 to 50, wherein at least one gene in said second EPS gene cluster is inactivated, e.g., by deletion of part of or the entire gene sequence.
52. The bacterium according to any one of items 31 to 51, wherein the second EPS gene cluster is inactivated.
53. The bacterium according to any one of items 31 to 52, wherein the second EPS gene cluster is inactivated by deletion of part of or the entire sequence of said cluster.
54. The bacterium according to any one of items 31 to 52, wherein the second EPS gene cluster is inactivated by modification of (e.g., by introducing at least one mutation in) the promoter and/or ribosome binding site region resulting in the lack of gene expression.
55. The bacterium according to any one of 1 to 52, wherein all endogenous genes encoding enzymes involved in the production of exopolysaccharides (EPS) in said bacterium are inactivated, e.g., deleted.
56. The bacterium according to any one of items 1 to 55, wherein the bacterium is selected from *Methylobacillus flagellatus, Methylobacillus glycogenes, Methylobacillus pratensis, Methylobacillus rhizosphaerae, Methylobacillus gramineus, Methylobacillus arboreus, Methylobacillus caricics, Methylobacillus methilovorans* and *Methylobacillus* sp.
57. The bacterium according to any one of items 1 to 56, wherein the bacterium is selected from *Methylobacillus flagellatus* and *Methylobacillus glycogenes.*
58. The bacterium according to any one of items 1 to 55, wherein the bacterium is *Methylobacillus flagellatus.*
59. The bacterium according to any one of items 1 to 55, wherein the bacterium is *Methylobacillus glycogenes.*
60. A method for the production of a biochemical compound comprising cultivating a bacterium according to any one of items 1 to 59 under suitable culture conditions in a culture medium comprising a reduced one-carbon compound, such as methanol, or a multi-carbon compound that contains no carbon-carbon bonds, such as dimethylamine.
61. The method according to item 60, wherein the culture medium comprises methanol.
62. The method according to item 60 or 61, wherein the cultivation is performed in a bioreactor.
63. The method according to any one of items 60 to 62, wherein the biochemical compound is selected from organic acids, amino acids, fatty acids and derivatives thereof.

Figure 1:
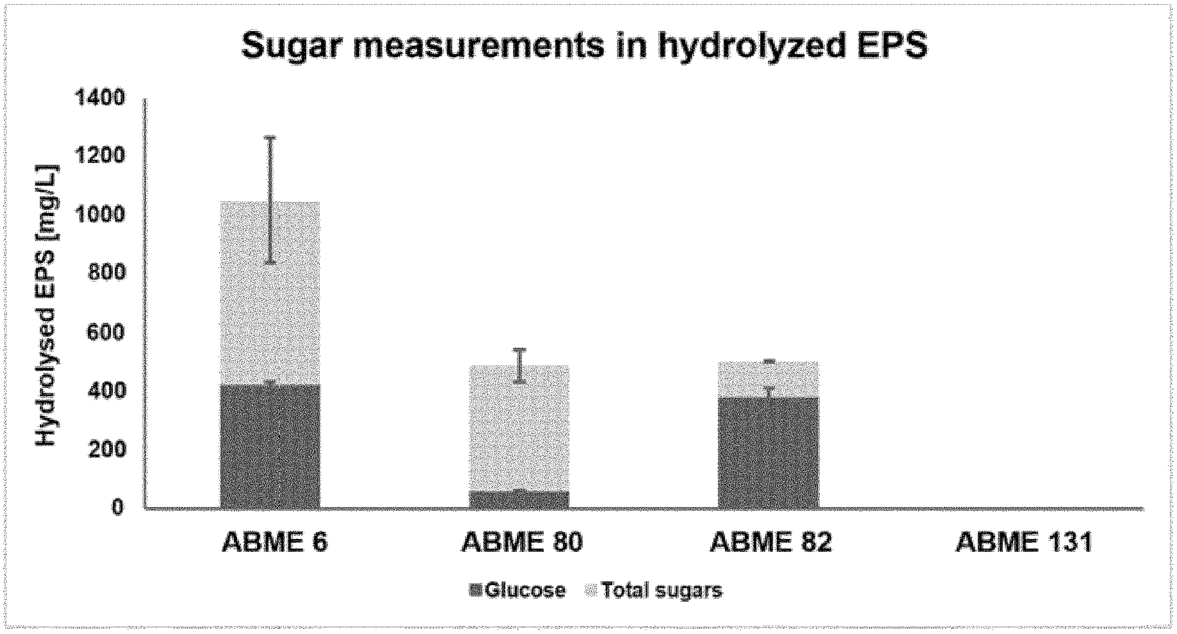
FIG. 1: Sugar content of hydrolyzed *M. flagellatus* shake-flask supernatant. Dark gray bars represent the total glucose in mg/L and the light gray bars represent total monomeric sugars. Error bars are the standard deviation of technical replicates.

The present invention is now described in more detail below.

DETAILED DESCRIPTION OF THE INVENTION

Unless specifically defined herein, all technical and scientific terms used have the same meaning as commonly understood by a skilled artisan in the fields of biochemistry, genetics, and microbiology.

All methods and materials similar or equivalent to those described herein can be used in the practice or testing of the present invention, with suitable methods and materials being described herein. All publications, patent applications, patents, and other references mentioned herein are incorporated by reference in their entirety. In case of conflict, the present specification, including definitions, will prevail. Further, the materials, methods, and examples are illustrative only and are not intended to be limiting, unless otherwise specified.

The practice of the present invention will employ, unless otherwise indicated, conventional techniques of cell biology, cell culture, molecular biology, transgenic biology, microbiology, and recombinant DNA, which are within the skill of the art. Such techniques are explained fully in the literature. See, for example, Current Protocols in Molecular Biology (Frederick M. AUSUBEL, 2000, Wiley and son Inc, Library of Congress, USA); Molecular Cloning: A Laboratory Manual, Third Edition, (Sambrook et al, 2001, Cold Spring Harbor, New York: Cold Spring Harbor Laboratory Press); Oligonucleotide Synthesis (M. J. Gait ed., 1984); Mullis et al. U.S. Pat. No. 4,683,195; Nucleic Acid Hybridization (B. D. Harries & S. J. Higgins eds. 1984); Transcription And Translation (B. D. Hames & S. J. Higgins eds. 1984); Culture Of Animal Cells (R. I. Freshney, Alan R. Liss, Inc., 1987); Immobilized Cells And Enzymes (IRL Press, 1986); B. Perbal, A Practical Guide To Molecular Cloning (1984); the series, Methods In ENZYMOLOGY (J. Abelson and M. Simon, eds.-in-chief, Academic Press, Inc., New York), specifically, Vols. 154 and 155 (Wu et al. eds.) and Vol. 185, "Gene Expression Technology" (D. Goeddel, ed.); Gene Transfer Vectors For Mammalian Cells (J. H. Miller and M. P. Calos eds., 1987, Cold Spring Harbor Laboratory).

Bacterium of the Invention

As indicated above, the present invention is based on the unexpected and surprising finding that certain drawbacks in methanol-based bioprocesses can be overcome by down-regulating the production of exopolysaccharides (EPS) in bacteria of the genus *Methylobacillus.*

The present invention thus provides in a first aspect a genetically engineered bacterium of the genus *Methylobacillus* which has been modified to have a decreased production of exopolysaccharides (EPS) compared to an otherwise identical bacterium that does not carry said modification.

More specifically, the present invention provides a genetically engineered bacterium of the genus *Methylobacillus* which has been modified to have a decreased expression and/or activity of at least one endogenous polypeptide involved in the production of exopolysaccharides (EPS) in said bacterium compared to an otherwise identical bacterium that does not carry said modification (reference bacterium).

According to some embodiments, the genetically engineered bacterium of the invention has been modified to have a decreased expression of at least one, such as at least two, endogenous polypeptide involved in the production of exopolysaccharides (EPS) in said bacterium compared to an otherwise identical bacterium that does not carry said modification (reference bacterium).

According to some embodiments, the genetically engineered bacterium of the invention has been modified to have a decreased expression of at least three, such as at least four, endogenous polypeptides involved in the production of exopolysaccharides (EPS) in said bacterium compared to an otherwise identical bacterium that does not carry said modification (reference bacterium).

According to some embodiments, the genetically engineered bacterium of the invention has been modified to have a decreased expression of at least five, such as at least six, endogenous polypeptides involved in the production of exopolysaccharides (EPS) in said bacterium compared to an otherwise identical bacterium that does not carry said modification (reference bacterium).

According to some embodiments, the genetically engineered bacterium of the invention has been modified to have a decreased expression of at least seven, such as at least eight, endogenous polypeptides involved in the production of exopolysaccharides (EPS) in said bacterium compared to an otherwise identical bacterium that does not carry said modification (reference bacterium).

According to some embodiments, the genetically engineered bacterium of the invention has been modified to have a decreased expression of at least nine, such as at least ten, endogenous polypeptides involved in the production of exopolysaccharides (EPS) in said bacterium compared to an otherwise identical bacterium that does not carry said modification (reference bacterium).

According to some embodiments, the genetically engineered bacterium of the invention has been modified to have a decreased expression of at least eleven, such as at least twelve, endogenous polypeptides involved in the production of exopolysaccharides (EPS) in said bacterium compared to an otherwise identical bacterium that does not carry said modification (reference bacterium).

According to some embodiments, the genetically engineered bacterium of the invention has been modified to have a decreased expression of at least thirteen, such as at least fourteen, endogenous polypeptides involved in the production of exopolysaccharides (EPS) in said bacterium compared to an otherwise identical bacterium that does not carry said modification (reference bacterium).

According to some embodiments, the genetically engineered bacterium of the invention has been modified to have a decreased expression of at least fifteen, such as at least sixteen, endogenous polypeptides involved in the production of exopolysaccharides (EPS) in said bacterium compared to an otherwise identical bacterium that does not carry said modification (reference bacterium).

According to some embodiments, the genetically engineered bacterium of the invention has been modified to have a decreased expression of all endogenous polypeptides involved in the production of exopolysaccharides (EPS) in said bacterium compared to an otherwise identical bacterium that does not carry said modification (reference bacterium).

According to some embodiments, the at least one polypeptide involved in the production of exopolysaccharides (EPS) in said bacterium is selected from the group consisting of a) polypeptides comprising an amino acid sequence set forth in any one of SEQ ID NO: 1 to 38 and b) polypeptides comprising an amino acid sequence having at least 70%%, such as at least 75%, at least 80%, at least 85%, at least 90% or at least 95%, sequence identity with any one of SEQ ID NO: 1 to 38 and having the same functional property as the reference polypeptide.

According to some embodiments, the at least one polypeptide involved in the production of exopolysaccharides (EPS) in said bacterium is selected from the group consisting of a) polypeptides comprising an amino acid sequence set forth in any one of SEQ ID NO: 1 to 26 and b) polypeptides comprising an amino acid sequence having at least 70%%, such as at least 75%, at least 80%, at least 85%, at least 90% or at least 95%, sequence identity with any one of SEQ ID NO: 1 to 26 and having the same functional property as the reference polypeptide.

According to some embodiments, the at least one polypeptide involved in the production of exopolysaccharides (EPS) in said bacterium is selected from the group consisting of a) polypeptides comprising an amino acid sequence set forth in any one of SEQ ID NO: 27 to 38 and b) polypeptides comprising an amino acid sequence having at least 70%%, such as at least 75%, at least 80%, at least 85%, at least 90% or at least 95%, sequence identity with any one of SEQ ID NO: 27 to 38 and having the same functional property as the reference polypeptide.

According to some embodiments, the at least one polypeptide involved in the production of exopolysaccharides (EPS) in said bacterium is selected from the group consisting of a) polypeptides comprising an amino acid sequence set forth in any one of SEQ ID NO: 39 to 86 and b) polypeptides comprising an amino acid sequence having at least 70%, such as at least 75%, at least 80%, at least 85%, at least 90% or at least 95%, sequence identity with any one of SEQ ID NO: 39 to 86 and having the same functional property as the reference polypeptide.

According to some embodiments, the the at least one polypeptide involved in the production of exopolysaccharides (EPS) in said bacterium is selected from the group consisting of a) polypeptides comprising an amino acid sequence set forth in any one of SEQ ID NO: 39 to 60 and b) polypeptides comprising an amino acid sequence having at least 70%, such as at least 75%, at least 80%, at least 85%, at least 90% or at least 95%, sequence identity with any one of SEQ ID NO: 39 to 60 and having the same functional property as the reference polypeptide.

According to some embodiments, the at least one enzyme involved in the production of exopolysaccharides (EPS) in said bacterium is selected from the group consisting of a) polypeptides comprising an amino acid sequence set forth in any one of SEQ ID NO: 61 to 86 and b) polypeptides comprising an amino acid sequence having at least 70%%, such as at least 75%, at least 80%, at least 85%, at least 90% or at least 95%, sequence identity with any one of SEQ ID NO: 61 to 86 and having the same functional property as the reference polypeptide.

According to some embodiments, the at least one polypeptide involved in the production of exopolysaccharides (EPS) in said bacterium is selected from the group consisting a polypeptide having peptidyl-prolyl cis-trans isomerase activity, a polypeptide capable of acting as a polysaccharide exporter; a polypeptide acting as a chain length determinant protein; and a polypeptide having protein-tyrosine kinase activity.

According to some embodiments, the polypeptide having peptidyl-prolyl cis-trans isomerase activity comprises an amino acid sequence having at least 70% sequence identity to SEQ ID NO: 6.

According to some embodiments, the polypeptide capable of acting as a polysaccharide exporter comprises an amino acid sequence having at least 70% sequence identity to SEQ ID NO: 7.

According to some embodiments, the polypeptide acting as a chain length determinant protein comprises an amino acid sequence having at least 70% sequence identity to SEQ ID NO: 8.

According to some embodiments, the polypeptide having protein-tyrosine kinase activity comprises an amino acid sequence having at least 70% sequence identity to SEQ ID NO: 9.

According to some embodiments, the polypeptide having peptidyl-prolyl cis-trans isomerase activity comprises an amino acid sequence having at least 70% sequence identity to SEQ ID NO: 42.

According to some embodiments, the polypeptide capable of acting as a polysaccharide exporter comprises an amino acid sequence having at least 70% sequence identity to SEQ ID NO: 43.

According to some embodiments, the polypeptide acting as a chain length determinant protein comprises an amino acid sequence having at least 70% sequence identity to SEQ ID NO: 44.

According to some embodiments, the polypeptide having protein-tyrosine kinase activity comprises an amino acid sequence having at least 70% sequence identity to SEQ ID NO: 45.

The expression level of the endogenous polypeptide(s) may, for example, be decreased by at least 50%, such as by at least 60%, at least 65%, at least 70%, at least 75%, at least 80%, at least 85%, at least 90%, at least 95% or at least 100% compared to the otherwise identical bacterium.

A decrease of the expression of the endogenous polypeptide(s) may be achieved by any suitable means known in the art. For example, the expression may be decrease by inactivating the endogenous gene(s) encoding said polypeptide (s) involved in the production of exopolysaccharides (EPS) in the bacterium, such as by deletion of part of or the entire gene sequence.

According to some embodiments, the expression of the at least one polypeptide involved in the production of exopolysaccharides (EPS) in said bacterium is abolished compared to the otherwise identical bacterium.

According to some embodiments, the endogenous gene/s encoding said polypeptide/s involved in the production of exopolysaccharides (EPS) in the bacterium has/have been inactivated, such as by deletion of part of or the entire gene sequence.

According to some embodiments, the endogenous gene/s encoding said polypeptide/s involved in the production of exopolysaccharides (EPS) in said bacterium has/have been inactivated by introducing or expressing in the bacterium a rare-cutting endonuclease able to selectively inactivating by DNA cleavage the endogenous gene encoding said enzyme. A rare-cutting endonuclease to be used in accordance of the present invention to inactivate the endogenous gene may, for instance, be a transcription activator-like effector (TALE) nuclease, meganuclease, zing-finger nuclease (ZFN), or RNA-guided endonuclease.

One way to inactivate an endogenous gene encoding a polypeptide involved in the production of exopolysaccharides (EPS) in the bacterium is to use the CRISPRi system. The CRISPRi system was developed as a tool for targeted repression of gene expression or for blocking targeted locations on the genome. The CRISPRi system consists of the catalytically inactive, "dead" Cas9 protein (dCas9) and a guide RNA that defines the binding site for the dCas9 to DNA.

According to some embodiments, the expression of an endogenous polypeptide involved in the production of exopolysaccharides (EPS) in the bacterium is decreased by way of inhibition.

Inhibition of the expression of said polypeptide may be achieved by any suitable means known in the art. For example, the expression may be inhibited by gene silencing techniques involving the use of inhibitory nucleic acid molecules, such as antisense oligonucleotides, ribozymes or interfering RNA (RNAi) molecules, such as microRNA (miRNA), small interfering RNA (siRNA) or short hairpin RNA (shRNA).

According to some embodiments, the expression of an endogenous polypeptide involved in the production of exopolysaccharides (EPS) in the bacterium is decreased (e.g., inhibited) by transcriptional and/or translational repression of the endogenous gene encoding said polypeptide.

According to some embodiments, the expression of an endogenous polypeptide involved in the production of exopolysaccharides (EPS) in the bacterium is inhibited by introducing or expressing in the bacterium an inhibitory nucleic acid molecule. For example, the inhibitory nucleic acid molecule may be introduced by way of an exogenous nucleic acid molecule comprising a nucleotide sequence encoding said inhibitory nucleic acid molecule operably linked to a promoter, such as an inducible promoter, that is functional in the bacterium to cause the production of said inhibitory nucleic acid molecule. Suitably, the inhibitory nucleic acid molecule is one that specifically hybridizes (e.g. binds) under cellular conditions with cellular mRNA and/or genomic DNA encoding the endogenous polypeptide in question. Depending on the target, transcription of the encoding genomic DNA and/or translation of the encoding mRNA is/are inhibited.

According to some embodiments, the inhibitory nucleic acid molecule is an antisense oligonucleotide, ribozyme or interfering RNA (RNAi) molecule. Preferably, such nucleic acid molecule comprises at least 10 consecutive nucleotides of the complement of the cellular mRNA and/or genomic DNA encoding the polypeptide in question.

According to some embodiments, the inhibitory nucleic acid is an antisense oligonucleotide. Such antisense oligonucleotide is a nucleic acid molecule (either DNA or RNA) which specifically hybridizes (e.g. binds) under cellular conditions with the cellular mRNA and/or genomic DNA encoding the enzyme in question.

According to some embodiments, the inhibitory nucleic acid molecule is a ribozyme, such as a hammerhead ribozyme. A ribozyme molecule is designed to catalytically cleave the mRNA transcript to prevent translation of the polypeptide in question.

According to some embodiments, the inhibitory nucleic acid molecule is an interfering RNA (RNAi) molecule. RNA interference is a biological process in which RNA molecules inhibit expression, typically causing the destruction of specific mRNA. Exemplary types of RNAi molecules include microRNA (miRNA), small interfering RNA (siRNA) and short hairpin RNA (shRNA). According to some embodiments, the RNAi molecule is a miRNA. According to some embodiments, the RNAi molecule is a siRNA. According to some embodiments, the RNAi molecule is a shRNA.

According to some embodiments, bacterium of the invention has been modified to have a decreased function (e.g. activity) of at least one polypeptide involved in the production of exopolysaccharides (EPS) in the bacterium compared to an otherwise identical microorganism that does not carry said modification (reference bacterium).

A decrease of the function (e.g. activity) of the at least one endogenous polypeptide may be achieved by any suitable means known in the art. For example, if the polypeptide is an enzyme the activity may be decrease by introducing one or more mutations in the active site of the enzyme resulting in the reduction or loss of activity. Thus, according to some embodiments, the activity of the at least one endogenous enzyme involved in the production of exopolysaccharides (EPS) in the bacterium is decreased by at least one active-site mutation resulting in the reduction or loss of activity. The at least one active-site mutation may, for example, be at least one non-conservative amino acid substitution.

As noted above, the present inventors have identified two putative EPS gene clusters in the genome of *Methylobacilli*. The endogenous polypeptide or polypeptides involved in the production of exopolysaccharides (EPS) is/are thus encoded by a gene or genes included in a first EPS gene cluster and/or second EPS gene cluster.

According to some embodiments, the endogenous polypeptide or polypeptides involved in the production of exopolysaccharides (EPS) in said bacterium is/are encoded by a gene or genes included in a first EPS gene cluster and/or second EPS gene cluster.

According to some embodiments, the first EPS gene cluster includes genes defined by or orthologous to the open reading frames (ORFS) found in SEQ ID NO: 174 or 177.

According to some embodiments, the first EPS gene cluster includes the genes epsD, epsE, epsF, epsG, epsB, epsL, epsH, epsI, epsJ and epsS, or orthologs thereof.

According to some embodiments, the first EPS gene cluster includes the genes epsD, epsE, epsF and epsG, or orthologs thereof.

According to some embodiments, the first EPS gene cluster includes a nucleotide sequence which has at least 50%, such as at least 55%, sequence identity with the nucleotide sequence of SEQ ID NO: 174 or 177.

According to some embodiments, the first EPS gene cluster includes a nucleotide sequence which has at least 60%, such as at least 65%, sequence identity with the nucleotide sequence of SEQ ID NO: 174 or 177.

According to some embodiments, the first EPS gene cluster includes a nucleotide sequence which has at least 70%, such as at least 75%, sequence identity with the nucleotide sequence of SEQ ID NO: 174 or 177.

According to some embodiments, the first EPS gene cluster includes a nucleotide sequence which has at least 80%, such as at least 85%, sequence identity with the nucleotide sequence of SEQ ID NO: 174 or 177.

According to some embodiments, the first EPS gene cluster includes a nucleotide sequence which has at least 90%, such as at least 93%, sequence identity with the nucleotide sequence of SEQ ID NO: 174 or 177.

According to some embodiments, the first EPS gene cluster includes a nucleotide sequence which has at least 95%, such as at least 97%, sequence identity with the nucleotide sequence of SEQ ID NO: 174 or 177.

According to some embodiments, the first EPS gene cluster includes a nucleotide sequence which has at least 50%, such as at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79% at least, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95% at least 96%, at least 97%, at least 98% or at least 99%, sequence identity with the nucleotide sequence of SEQ ID NO: 174.

According to some embodiments, the first EPS gene cluster includes a nucleotide sequence which has at least 50%, such as at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79% at least, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95% at least 96%, at least 97%, at least 98% or at least 99%, sequence identity with the nucleotide sequence of SEQ ID NO: 177.

According to some embodiments, the second EPS gene cluster includes genes defined by or orthologous to the open reading frames (ORFS) found in SEQ ID NO: 175 or 179.

According to some embodiments, the second EPS gene cluster includes a nucleotide sequence which has at least 50%, such as at least 55%, sequence identity with the nucleotide sequence of 175 or 179.

According to some embodiments, the second EPS gene cluster includes a nucleotide sequence which has at least 60%, such as at least 65%, sequence identity with the nucleotide sequence of 175 or 179.

According to some embodiments, the second EPS gene cluster includes a nucleotide sequence which has at least 70%, such as at least 75%, sequence identity with the nucleotide sequence of 175 or 179.

According to some embodiments, the second EPS gene cluster includes a nucleotide sequence which has at least 80%, such as at least 85%, sequence identity with the nucleotide sequence of 175 or 179.

According to some embodiments, the second EPS gene cluster includes a nucleotide sequence which has at least 90%, such as at least 85%, sequence identity with the nucleotide sequence of 175 or 179.

According to some embodiments, the second EPS gene cluster includes a nucleotide sequence which has at least 50%, such as at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79% at least, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95% at least 96%, at least 97%, at least 98% or at least 99%, sequence identity with the nucleotide sequence of 175.

According to some embodiments, the second EPS gene cluster includes a nucleotide sequence which has at least 50%, such as at least 51%, at least 52%, at least 53%, at least 54%, at least 55%, at least 56%, at least 57%, at least 58%, at least 59%, at least 60%, at least 61%, at least 62%, at least 63%, at least 64%, at least 65%, at least 66%, at least 67%, at least 68%, at least 69%, at least 70%, at least 71%, at least 72%, at least 73%, at least 74%, at least 75%, at least 76%, at least 77%, at least 78%, at least 79% at least, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95% at least 96%, at least 97%, at least 98% or at least 99%, sequence identity with the nucleotide sequence of 179.

According to some embodiments, at least one gene in said first EPS gene cluster is inactivated, e.g., by deletion of part of or the entire gene sequence.

According to some embodiments, the at least one gene is selected from epsD, epsE, epsF, epsG, epsB, epsL, epsH, epsI, epsJ and epsS, or ortholog thereof.

According to some embodiments, the at least one gene is selected from epsD, epsE, epsF and epsG, or ortholog thereof.

According to some embodiments, the genes epsD, epsE, epsF and epsG, or orthologs thereof, are inactivated, e.g., by deletion of part of or the entire gene sequence.

According to some embodiments, the gene epsD encodes a polypeptide comprising an amino acid sequence having at least 70%, such as at least 75%, sequence identity to SEQ ID NO: 6, the gene epsE encodes a polypeptide comprising an amino acid sequence having at least 70%, such as at least 75%, sequence identity to SEQ ID NO: 7, the gene epsF encodes a polypeptide comprising an amino acid sequence having at least 70%, such as at least 75%, sequence identity to SEQ ID NO: 8, and the gene epsG encodes a polypeptide comprising an amino acid sequence having at least 70%, such as at least 75%, sequence identity to SEQ ID NO: 9.

According to some embodiments, the gene epsD encodes a polypeptide comprising an amino acid sequence having at least 80%, such as at least 85%, sequence identity to SEQ ID NO: 6, the gene epsE encodes a polypeptide comprising an amino acid sequence having at least 80%, such as at least 85%, sequence identity to SEQ ID NO: 7, the gene epsF encodes a polypeptide comprising an amino acid sequence having at least 80%, such as at least 85, sequence identity to SEQ ID NO: 8, and the gene epsG encodes a polypeptide comprising an amino acid sequence having at least 80%, such as at least 85%, sequence identity to SEQ ID NO: 9.

According to some embodiments, the gene epsD encodes a polypeptide comprising an amino acid sequence having at least 90%, such as at least 95%, sequence identity to SEQ ID NO: 6, the gene epsE encodes a polypeptide comprising an amino acid sequence having at least 90%, such as at least 95%, sequence identity to SEQ ID NO: 7, the gene epsF encodes a polypeptide comprising an amino acid sequence having at least 90%, such as at least 95, sequence identity to SEQ ID NO: 8, and the gene epsG encodes a polypeptide comprising an amino acid sequence having at least 90%, such as at least 95%, sequence identity to SEQ ID NO: 9.

According to some embodiments, the epsD gene comprises a nucleotide sequence having at least 70%, such as at least 75%, sequence identity with SEQ ID NO: 92, the gene epsE comprises a nucleotide sequence having at least 70%, such as at least 75%, sequence identity with SEQ ID NO: 93, the gene epsF comprises an nucleotide sequence having at least 70%, such as at least 75% sequence identity with SEQ ID NO: 94, and the gene epsG comprises an nucleotide sequence having at least 70%, such as at least 75%, sequence identity with SEQ ID NO: 95.

According to some embodiments, the epsD gene comprises a nucleotide sequence having at least 80%, such as at least 85%, sequence identity with SEQ ID NO: 92, the gene epsE comprises a nucleotide sequence having at least 80%, such as at least 85%, sequence identity with SEQ ID NO: 93, the gene epsF comprises an nucleotide sequence having at least 80%, such as at least 85% sequence identity with SEQ ID NO: 94, and the gene epsG comprises an nucleotide sequence having at least 80%, such as at least 85%, sequence identity with SEQ ID NO: 95.

According to some embodiments, the epsD gene comprises a nucleotide sequence having at least 90%, such as at least 95%, sequence identity with SEQ ID NO: 92, the gene epsE comprises a nucleotide sequence having at least 90%, such as at least 95%, sequence identity with SEQ ID NO: 93, the gene epsF comprises an nucleotide sequence having at least 90%, such as at least 95% sequence identity with SEQ ID NO: 94, and the gene epsG comprises an nucleotide sequence having at least 90%, such as at least 95% sequence identity with SEQ ID NO: 95.

According to some embodiments, the gene epsD encodes a polypeptide comprising an amino acid sequence having at least 70%, such as at least 75%, sequence identity to SEQ ID NO: 42, the gene epsE encodes a polypeptide comprising an amino acid sequence having at least 70%, such as at least 75%, sequence identity to SEQ ID NO: 43, the gene epsF encodes a polypeptide comprising an amino acid sequence having at least 70%, such as at least 75%, sequence identity to SEQ ID NO: 44, and the gene epsG encodes a polypeptide comprising an amino acid sequence having at least 70%, such as at least 75%, sequence identity to SEQ ID NO: 45.

According to some embodiments, the gene epsD encodes a polypeptide comprising an amino acid sequence having at least 80%, such as at least 85%, sequence identity to SEQ ID NO: 42, the gene epsE encodes a polypeptide comprising an amino acid sequence having at least 80%, such as at least 85%, sequence identity to SEQ ID NO: 43, the gene epsF encodes a polypeptide comprising an amino acid sequence having at least 80%, such as at least 85%, sequence identity to SEQ ID NO: 44, and the gene epsG encodes a polypeptide comprising an amino acid sequence having at least 80%, such as at least 85%, sequence identity to SEQ ID NO: 45.

According to some embodiments, the gene epsD encodes a polypeptide comprising an amino acid sequence having at least 90%, such as at least 95%, sequence identity to SEQ ID NO: 42, the gene epsE encodes a polypeptide comprising an amino acid sequence having at least 90%, such as at least 95%, sequence identity to SEQ ID NO: 43, the gene epsF encodes a polypeptide comprising an amino acid sequence having at least 90%, such as at least 95%, sequence identity to SEQ ID NO: 44, and the gene epsG encodes a polypeptide comprising an amino acid sequence having at least 90%, such as at least 95%, sequence identity to SEQ ID NO: 45.

According to some embodiments, the gene epsD comprises a nucleotide sequence having at least 70%, such as at least 75%, sequence identity with SEQ ID NO: 128, the gene epsE comprises a nucleotide sequence having at least 70%, such as at least 75%, sequence identity with SEQ ID NO: 129, the gene epsF comprises an nucleotide sequence having at least 70%, such as at least 75%, sequence identity with SEQ ID NO: 130, and the gene epsG comprises an nucleotide sequence having at least 70%, such as at least 75%, sequence identity with SEQ ID NO: 131.

According to some embodiments, the gene epsD comprises a nucleotide sequence having at least 80%, such as at least 85%, sequence identity with SEQ ID NO: 128, the gene epsE comprises a nucleotide sequence having at least 80%, such as at least 85%, sequence identity with SEQ ID NO: 129, the gene epsF comprises an nucleotide sequence having at least 80%, such as at least 85%, sequence identity with SEQ ID NO: 130, and the gene epsG comprises an nucleotide sequence having at least 80%, such as at least 85%, sequence identity with SEQ ID NO: 131.

According to some embodiments, the gene epsD comprises a nucleotide sequence having at least 90%, such as at least 95%, sequence identity with SEQ ID NO: 128, the gene epsE comprises a nucleotide sequence having at least 90%, such as at least 95%, sequence identity with SEQ ID NO: 129, the gene epsF comprises an nucleotide sequence having at least 90%, such as at least 95%, sequence identity with SEQ ID NO: 130, and the gene epsG comprises an nucleotide sequence having at least 90%, such as at least 95%, sequence identity with SEQ ID NO: 131.

According to some embodiments, the genetically engineered bacterium of the invention has been modified to inactivate the first EPS gene cluster.

According to some embodiments, the genetically engineered bacterium of the invention has been (further) modified to inactivate the second EPS gene cluster.

According to some embodiments, the genetically engineered bacterium of the invention has been modified to inactivate the first EPS gene cluster and second EPS gene cluster.

According to some embodiments, the first EPS gene cluster is inactivated by deletion of part of or the entire sequence of said cluster.

According to some embodiments, the first EPS gene cluster is inactivated by deletion of the entire coding sequence of said cluster.

According to some embodiments, the first EPS gene cluster is inactivated by deletion of the entire sequence of said cluster.

According to some embodiments, the first EPS gene cluster is inactivated by modification of (e.g., by introducing at least one mutation in) the promoter and/or ribosome binding site region resulting in the lack of gene expression.

According to some embodiments, the second EPS gene cluster is inactivated by deletion of part of or the entire sequence of said cluster.

According to some embodiments, the second EPS gene cluster is inactivated by deletion of the entire coding sequence of said cluster.

According to some embodiments, the second EPS gene cluster is inactivated by deletion of the entire sequence of said cluster.

According to some embodiments, the second EPS gene cluster is inactivated by modification of (e.g., by introducing at least one mutation in) the promoter and/or ribosome binding site region resulting in the lack of gene expression.

According to some embodiments, the genetically engineered bacterium of the invention has been modified to delete a nucleotide sequence having at least 70%, such as at least 75%, sequence identity with SEQ ID NO: 181 or 183. According to some embodiments, the genetically engineered bacterium of the invention has been modified to delete a nucleotide sequence having at least 80%, such as at least 85%, sequence identity with SEQ ID NO: 181 or 183. According to some embodiments, the genetically engineered bacterium of the invention has been modified to delete a nucleotide sequence having at least 90%, such as at least 95%, sequence identity with SEQ ID NO: 181 or 183.

According to some embodiments, the genetically engineered bacterium of the invention has been modified to delete a nucleotide sequence having at least 70%, such as at least 75%, sequence identity with SEQ ID NO: 182 or 184. According to some embodiments, the genetically engineered bacterium of the invention has been modified to delete a nucleotide sequence having at least 80%, such as at least 85%, sequence identity with SEQ ID NO: 182 or 184. According to some embodiments, the genetically engineered bacterium of the invention has been modified to delete a nucleotide sequence having at least 90%, such as at least 95%, sequence identity with SEQ ID NO: 182 or 184.

According to some embodiments, the genetically engineered bacterium of the invention has been modified to delete a nucleotide sequence having at least 70%, such as at least 75%, sequence identity with SEQ ID NO: 181 and to delete a nucleotide sequence having at least 70%, such as at least 75%, sequence identity with SEQ ID NO: 182. According to some embodiments, the genetically engineered bacterium of the invention has been modified to delete a nucleotide sequence having at least 80%, such as at least 85%, sequence identity with SEQ ID NO: 181 and to delete a nucleotide sequence having at least 80%, such as at least 85%, sequence identity with SEQ ID NO: 182. According to some embodiments, the genetically engineered bacterium of the invention has been modified to delete a nucleotide sequence having at least 90%, such as at least 95%, sequence identity with SEQ ID NO: 181 and to delete a nucleotide sequence having at least 90%, such as at least 95%, sequence identity with SEQ ID NO: 182.

According to some embodiments, the genetically engineered bacterium of the invention has been modified to delete a nucleotide sequence having at least 70%, such as at least 75%, sequence identity with SEQ ID NO: 183 and to delete a nucleotide sequence having at least 70%, such as at least 75%, sequence identity with SEQ ID NO: 184. According to some embodiments, the genetically engineered bacterium of the invention has been modified to delete a nucleotide sequence having at least 80%, such as at least 85%, sequence identity with SEQ ID NO: 183 and to delete a nucleotide sequence having at least 80%, such as at least 85%, sequence identity with SEQ ID NO: 184. According to some embodiments, the genetically engineered bacterium of the invention has been modified to delete a nucleotide sequence having at least 90%, such as at least 95%, sequence identity with SEQ ID NO: 183 and to delete a nucleotide sequence having at least 90%, such as at least 95%, sequence identity with SEQ ID NO: 184.

According to some embodiments, the genetically engineered bacterium of the invention has been modified to delete all endogenous genes encoding polypeptides involved in the production of exopolysaccharides (EPS) in said bacterium.

A bacterium in accordance with the present invention can be produced from any suitable bacterium of the genus *Methylobacillus. Methylobacillus* is a genus of Gram-negative methylotrophic bacteria.

According to some embodiments, the bacterium of the present invention is selected from *Methylobacillus flagellatus, Methylobacillus glycogenes, Methylobacillus pratensis* and *Methylobacillus rhizosphaerae.*

According to some embodiments, the bacterium of the present invention is selected from *Methylobacillus flagellates* and *Methylobacillus glycogenes.*

According to some embodiments, the bacterium of the present invention is *Methylobacillus flagellatus.*

According to some embodiments, the bacterium of the present invention is *Methylobacillus glycogenes.*

Method of the Invention

The present invention also provides methods for producing a biochemical compound comprising cultivating a bacterium according to the invention under suitable culture conditions in a culture medium comprising a reduced one-carbon compound, such as methanol, or a multi-carbon compound that contain no carbon-carbon bonds, such as dimethylamine.

The culture medium employed may be any conventional medium suitable for culturing a bacterium cell in question, and may be composed according to the principles of the prior art. The medium will usually contain all nutrients necessary for the growth and survival of the respective bacterium, such as carbon and nitrogen sources and other inorganic salts. Suitable media, e.g. minimal or complex media, are available from commercial suppliers, or may be prepared according to published receipts, e.g. the American Type Culture Collection (ATCC) Catalogue of strains. Non-limiting standard medium well known to the skilled person include Luria Bertani (LB) broth, Sabouraud Dextrose (SD) broth, MS broth, Yeast Peptone Dextrose, BM MY, GM MY, or Yeast Malt Extract (YM) broth, which are all commercially available. A non-limiting example of suitable media for culturing bacterial cells, such as *E. coli* cells, including minimal media and rich media such as Luria Broth (LB), M9 media, M17 media, SA media, MOPS media, Terrific Broth, YT and others.

The carbon source may be any suitable carbon substrate known in the art, and in particularly any carbon substrate commonly used in the cultivation of methylotrophic bacteria and/or fermentation. A carbon source of particular interest is a reduced one-carbon compound, such as methanol or methylamine, or a multi-carbon compound that contains no carbon-carbon bonds, such as dimethylamine. Thus, according to some embodiments, the culture medium comprises methanol as a carbon source. The concentration of methanol in the culture medium may generally be in the range from about 0,5% w/v to about 4% w/v, such as from about 2% w/v to about 4% w/v. According to some embodiments, the concentration of methanol in the culture medium is in the range from about 2,5% w/v to about 3,5% w/v.

As the nitrogen source, various ammonium salts such as ammonia and ammonium sulfate, other nitrogen compounds such as amines, a natural nitrogen source such as peptone, soybean-hydrolysate, and digested fermentative microorganism can be used. As minerals, potassium monophosphate, magnesium sulfate, sodium chloride, ferrous sulfate, manganese sulfate, calcium chloride, and the like can be used.

The cultivation can be preferably performed under aerobic conditions, such as by a shaking culture, by a stirring culture or in a bioreactor with aeration, at a temperature of about 20 to about 45° C., such as about 30 to 38° C., preferably at about 37° C. The pH of the culture is usually above 5, such as in a range from about 6 to about 8, preferably from about 6.5 to about 7.5, more preferably from about 6.8 to about 7.2. The pH of the culture can be adjusted with ammonia, calcium carbonate, various acids, various bases, and buffers. The cultivation may be carried out for a period in the range from 10 to 70 h, preferably in a range from 24 to 60 h, more preferably in a range from 36 to 50 h.

After cultivation, solids such as cells can be removed from the culture medium by centrifugation or membrane filtration. The biochemical compound can be collected by conventional method for isolation and purification chemical compounds from a medium. Well-known purification procedures include, but are not limited to, centrifugation or filtration, precipitation, ion exchange, chromatographic methods such as e.g. ion exchange chromatography or gel filtration chromatography, and crystallization methods. The method may further comprise collecting the biochemical compound from the culture medium.

The biochemical compound produced by the method of the present invention may be any desired compound obtained through the cultivation of a bacterium of the present invention. Non-limiting examples include organic acids, amino acids, fatty acids and derivatives thereof. Non-limiting examples of organic acids include fumarate, glycolate, succinate, malate, malonate, lactates and derivatives thereof. Non-limiting examples of amino acids include glutamate, lysine, methionine, tryptophan, phenylalanine and derivatives thereof.

The present invention thus provides a biochemical compound obtainable by a method as detailed herein.

Certain Other Definitions

"Polypeptide" and "protein" are used interchangeably herein to denote a polymer of at least two amino acids covalently linked by an amide bond, regardless of length or post-translational modification (e.g., glycosylation, phosphorylation, lipidation, myristilation, ubiquitination, etc.). Included within this definition are D- and L-amino acids, and mixtures of D- and L-amino acids.

"Nucleic acid" or "polynucleotide" are used interchangeably herein to denote a polymer of at least two nucleic acid monomer units or bases (e.g., adenine, cytosine, guanine, thymine) covalently linked by a phosphodiester bond, regardless of length or base modification.

"Recombinant" or "non-naturally occurring" when used with reference to, e.g., a host cell, nucleic acid, or polypeptide, refers to a material, or a material corresponding to the natural or native form of the material, that has been modified in a manner that would not otherwise exist in nature, or is identical thereto but produced or derived from synthetic materials and/or by manipulation using recombinant techniques. Non-limiting examples include, among others, recombinant bacterial cells expressing genes that are not found within the native (non-recombinant) form of the cell or express native genes that are otherwise expressed at a different level.

"Heterologous" or "exogenous" as used herein in the context of a gene or nucleic acid molecule refer to a gene or nucleic acid molecule (i.e. DNA or RNA molecule) that does not occur naturally as part of the genome of the bacterium in which it is present or which is found in a location or locations in the genome that differ from that in which it occurs in nature. Thus, a "heterologous" or "exogenous" gene or nucleic acid molecule is not endogenous to the bacterium and has been exogenously introduced into the microorganism. A "heterologous" gene or nucleic acid molecule DNA molecule may be from a different organism, a different species, a different genus or a different kingdom, as the host DNA.

"Heterologous" as used herein in the context of a polypeptide means that a polypeptide is normally not found in or made (i.e. expressed) by the host microorganism, but derived from a different organism, a different species, a different genus or a different kingdom.

As used herein, the term "ortholog" or "orthologs" refers to genes, nucleic acid molecules encoded thereby, i.e., mRNA, or proteins encoded thereby that are derived from a common ancestor gene but are present in different species.

By "decreased expression" of a gene it is meant that the amount of the transcription product, respectively the amount of the polypeptide (e.g., enzyme) encoded by said gene produced by the modified bacterium is decreased compared to an otherwise identical bacterium that does not carry said modification. More particularly, by "decreased expression" of a gene it is meant that the amount of the transcription product, respectively the amount of the polypeptide (e.g., enzyme) encoded by said gene produced by the modified bacterium is decreased by at least 10%, such as at least 20%, at least 30%, at least 40%, at least 50% at least 60%, at least 70%, at least 80%, at least 90% or at least 100%, compared to an otherwise identical bacterium that does not carry said modification. The level of expression of a gene can be determined by well-known methods, including PCR, Southern blotting, and the like. In addition, the level of gene expression can be estimated by measuring the amount of mRNA transcribed from the gene using various well-known methods, including Northern blotting, quantitative RT-PCR, and the like. The amount of the polypeptide encoded by the gene can be measured by well-known methods, including ELISA, Immunohistochemistry or Western Blotting and the like.

Expression of a gene can be decreased by introducing a mutation into the gene in the genome of the bacterium so that the intracellular activity of the polypeptide encoded by the gene is decreased as compared to an otherwise identical bacterium that does not carry said mutation. Mutations which result in a decreased expression of the gene include the replacement of one nucleotide or more to cause an amino acid substitution in the polypeptide encoded by the gene (missense mutation), introduction of a stop codon (nonsense mutation), deletion or insertion of nucleotides to cause a frame shift, insertion of a drug-resistance gene, or deletion of a part of the gene or the entire gene (Qiu and Goodman, 1997; Kwon et al., 2000). Expression can also be decreased by modifying an expression regulating sequence such as the promoter, the Shine-Dalgarno (SD) sequence, etc. Expression of the gene can also be decreased by gene replacement (Datsenko and Wanner, 2000), such as the "lambda-red mediated gene replacement". The lambda-red mediated gene replacement is a particularly suitable method to inactive one or more genes as described herein.

"Inactivating", "inactivation" and "inactivated", when used in the context of a gene or gene cluster, means that the gene or gene cluster in question no longer expresses a functional protein. It is possible that the modified DNA region is unable to naturally express the gene or gene cluster due to the deletion of a part of or the entire sequence of the gene or gene cluster, the shifting of the reading frame of the gene or gene cluster, the introduction of missense/nonsense mutation(s), or the modification of the regulatory region of the gene or gene cluster, including sequences controlling gene expression, such as a promoter, enhancer, attenuator, ribosome-binding site, etc. Preferably, a gene or gene cluster of interest is inactivated by deletion of a part of or the entire sequence of the gene or gene cluster, such as by gene replacement. Inactivation may also be accomplished by introducing or expressing a rare-cutting endonuclease able to selectively inactivating by DNA cleavage, preferably by double-strand break, the gene or gene cluster of interest. A "rare-cutting endonuclease" within the context of the present invention includes transcription activator-like effector (TALE) nucleases, meganucleases, zing-finger nucleases (ZFN), and RNA-guided endonucleases.

The presence or absence of a gene or gene cluster in the genome of a bacterium can be detected by well-known methods, including PCR, Southern blotting, and the like. In addition, the level of gene expression can be estimated by measuring the amount of mRNA transcribed from the gene or gene cluster using various well-known methods, including Northern blotting, quantitative RT-PCR, and the like. The amount of the polypeptide encoded by the gene or gene cluster can be measured by well-known methods, including SDS-PAGE followed by an immunoblotting assay (Western blotting analysis), and the like.

As used herein, "decreased", "decreasing" or "decrease of" expression of a polypeptide (such as an enzyme as described herein) means that the expression of said polypeptide in a modified bacterium is reduced compared to the expression of said polypeptide in an otherwise identical bacterium that does not carry said modification (control). The expression of a polypeptide in a modified bacterium may be reduced by at least about 10%, and preferably by at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 99% or 100%, or any percentage, in whole integers between 10% and 100% (e.g., 6%, 7%, 8%, etc.), compared to the expression of said polypeptide in an otherwise identical bacterium that does not carry said modification (control). More particularly, "decreased", "decreasing" or "decrease of" expression of a polypeptide means that the amount of the polypeptide in the modified bacterium is reduced by at least about 10%, and preferably by at least about 20%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 99% or 100%, or any percentage, in whole integers between 10% and 100% (e.g., 6%, 7%, 8%, etc.), compared to the amount of said polypeptide in an otherwise identical bacterium that does not carry said modification (control). The expression or amount of a polypeptide in a bacterium can be determined by any suitable means know in the art, including techniques such as ELISA, Immunohistochemistry, Western Blotting or Flow Cytometry.

As used herein, "abolished" expression of a polypeptide (such as an enzyme as described herein) means that the expression of said polypeptide in a modified bacterium is not detectable compared to the expression of said polypeptide in an otherwise identical bacterium that does not carry said modification (control).

As used herein, "decreased", "decreasing" or "decrease of" activity of a polypeptide (such as an enzyme as described herein) means that the catalytic activity of said polypeptide in a modified bacterium is reduced compared to the catalytic activity of said polypeptide in an otherwise identical bacterium that does not carry said modification (control). The activity of a polypeptide in a modified bacterium may be reduced by at least about 10%, and preferably by at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 99% or 100%, or any percentage, in whole integers between 10% and 100% (e.g., 6%, 7%, 8%, etc.), compared to the expression of said polypeptide in an otherwise identical bacterium that does not carry said modification (control). The activity of a polypeptide in a bacterium can be determined by any suitable protein and enzyme activity assay.

"Expression" includes any step involved in the production of a polypeptide (e.g., encoded enzyme) including, but not limited to, transcription, post-transcriptional modification, translation, post-translational modification, and secretion.

As used herein, "regulatory region" of a gene or gene cluster refers to a nucleic acid sequence that affect the expression of a coding sequence. Regulatory regions are known in the art and include, but are not limited to, promoters, enhancers, transcription terminators, polyadenylation sites, matrix attachment regions and/or other elements that regulate expression of a coding sequence.

"Substitution" or "substituted" refers to modification of the polypeptide by replacing one amino acid residue with another, for instance the replacement of an Serine residue with a Glycine or Alanine residue in a polypeptide sequence is an amino acid substitution. When used with reference to a polynucleotide, "substitution" or "substituted" refers to modification of the polynucleotide by replacing one nucleotide with another, for instance the replacement of a cytosine with a thymine in a polynucleotide sequence is a nucleotide substitution.

"Conservative substitution", when used with reference to a polypeptide, refers to a substitution of an amino acid residue with a different residue having a similar side chain, and thus typically involves substitution of the amino acid in the polypeptide with amino acids within the same or similar class of amino acids. By way of example and not limitation, an amino acid with an aliphatic side chain may be substituted with another aliphatic amino acid, e.g., alanine, valine, leucine, and isoleucine; an amino acid with hydroxyl side chain is substituted with another amino acid with a hydroxyl side chain, e.g., serine and threonine; an amino acid having an aromatic side chain is substituted with another amino acid having an aromatic side chain, e.g., phenylalanine, tyrosine, tryptophan, and histidine; an amino acid with a basic side chain is substituted with another amino acid with a basic side chain, e.g., lysine and arginine; an amino acid with an acidic side chain is substituted with another amino acid with an acidic side chain, e.g., aspartic acid or glutamic acid; and a hydrophobic or hydrophilic amino acid is replaced with another hydrophobic or hydrophilic amino acid, respectively.

"Non-conservative substitution", when used with reference to a polypeptide, refers to a substitution of an amino acid in a polypeptide with an amino acid with significantly differing side chain properties. Non-conservative substitutions may use amino acids between, rather than within, the defined groups and affects (a) the structure of the peptide backbone in the area of the substitution (e.g., serine for glycine), (b) the charge or hydrophobicity, or (c) the bulk of the side chain. By way of example and not limitation, an exemplary non-conservative substitution can be an acidic amino acid substituted with a basic or aliphatic amino acid;

an aromatic amino acid substituted with a small amino acid; and a hydrophilic amino acid substituted with a hydrophobic amino acid.

As used herein, "vector" refers to a nucleic acid molecule capable of transporting another nucleic acid molecule to which it has been linked. One type of vector is a "plasmid", which refers to a circular double stranded nucleic acid loop into which additional nucleic acid segments can be ligated. Certain vectors are capable of directing the expression of genes to which they are operatively linked. Such vectors are referred to herein as "expression vectors". Certain other vectors are capable of facilitating the insertion of an exogenous nucleic acid molecule into a genome of a bacterium. Such vectors are referred to herein as "transformation vectors". In general, vectors of utility in recombinant nucleic acid techniques are often in the form of plasmids. In the present specification, "plasmid" and "vector" can be used interchangeably as the plasmid is the most commonly used form of a vector. Large numbers of suitable vectors are known to those of skill in the art and commercially available.

As used herein, "promoter" refers to a sequence of DNA, usually upstream (5') of the coding region of a structural gene, which controls the expression of the coding region by providing recognition and binding sites for RNA polymerase and other factors which may be required for initiation of transcription. The selection of the promoter will depend upon the nucleic acid sequence of interest. A suitable "promoter" is generally one which is capable of supporting the initiation of transcription in a bacterium of the invention, causing the production of an mRNA molecule.

As used herein, "operably linked" refers to a juxtaposition wherein the components described are in a relationship permitting them to function in their intended manner. A control sequence "operably linked" to a coding sequence is ligated in such a way that expression of the coding sequence is achieved under conditions compatible with the control sequence. A promoter sequence is "operably-linked" to a gene when it is in sufficient proximity to the transcription start site of a gene to regulate transcription of the gene.

"Percentage of sequence identity," "% sequence identity" and "percent identity" refers to sequence identity between a nucleotide sequence and a reference nucleotide sequence or between an amino acid sequence and a reference amino acid sequence. Sequence identity can be determined by comparing a position in each sequence which may be aligned for purposes of comparison. When a position in the compared sequence is occupied by the same base or amino acid, then the molecules are identical at that position. A degree of identity between nucleotide or amino acid sequences is a function of the number of identical or matching nucleotides or amino acids at positions shared by the nucleotide or amino acid sequences, respectively. Various alignment algorithms and/or programs may be used to calculate the identity between two sequences, including FASTA or BLAST which are available as a part of the GCG sequence analysis package (University of Wisconsin, Madison, Wis.), and can be used with default settings.

As used herein, the term "about" means plus or minus 10% of the numerical value of the number with which it is being used.

Where a numerical limit or range is stated herein, the endpoints are included. Also, all values and sub ranges within a numerical limit or range are specifically included as if explicitly written out.

As used herein, the indefinite articles "a" and "an" mean "at least one" or "one or more" unless the context clearly dictates otherwise.

As used herein, the terms "comprising", "including", "having" and grammatical variants thereof are to be taken as specifying the stated features, steps or components but do not preclude the addition of one or more additional features, steps, components or groups thereof.

Having generally described this invention, a further understanding can be obtained by reference to certain specific examples, which are provided herein for purposes of illustration only, and are not intended to be limiting unless otherwise specified.

EXAMPLES

Example 1: Identification of EPS-Producing Genes in *Methylobacillus flagellatus* and *Methylobacillus glycogenes*

Several genomic loci were chosen for disruption based on bioinformatic analysis. The genetic locations of two EPS-associated gene clusters in *Methylobacillus flagellatus* have been published previously (Chistoserdova et al., 2007). To annotate genes in the first *Methylobacillus flagellatus* EPS-producing gene cluster (SEQ ID NOs: 87-112), homologues for genes from the published *Methylobacillus* sp. 12S methanolan synthesis cluster (Yoshida et al., 2000) were compared to the *Methylobacillus flagellatus* genome via an NCBI BLAST protein search, using a custom written script in the Python programming language. Top hits were selected based on a computed combination-score consisting of E-value, query coverage and sequence identity. A single top hit for each gene was then manually located in the genome sequence and annotated. Locations of these top hits coincided with the location of the published first cluster. Since a clear homologue was not found for each gene, all genes between the most distant homologues were considered to be part of the cluster. Most such non-annotated genes coded for sugar and polysaccharide related genes. The same procedure was used to identify the completely non-annotated EPS cluster in *Methylobacillus glycogenes* (SEQ ID NOs: 125-146).

A second EPS-related cluster was predicted in the genome sequence of *Methylobacillus flagellatus* (SEQ ID NOs: 113-124). A BLAST search comparing these genes to the methanolan cluster was performed, finding no clear homologues. The protein product of each individual gene in this cluster was identified via a NCBI protein BLAST search against all non-redundant protein sequences and the top hit for each was chosen as described above. The protein sequence of each gene from this *Methylobacillus flagellatus* protein cluster was cross-searched in the *Methylobacillus glycogenes* genome using NCBI protein BLAST. The top hits were found to form a similar cluster in *Methylobacillus glycogenes* (SEQ ID NOs: 147-172).

The identified open reading frames (ORFS) in each EPS-related gene cluster are shown in Tables 1 to 4 below.

TABLE 1

| ORFs of EPS gene cluster 1 in *M. flagellatus* | | | |
|---|---|---|---|
| Amino acid sequence SEQ ID NO | Nucleotide sequence SEQ ID NO | S12 homolog | Predicted function/property |
| 1 | 87 | espA | Transcriptional regulator, LuxR family |
| 2 | 88 | espK | Cyclic nucleotide-binding domain (cNMP-BD)protein |
| 3 | 89 | N/A | Unknown |
| 4 | 90 | epsL | Exosortase B-associated extracellular polysaccharide biosynthesis transporter EpsL |
| 5 | 91 | epsB | Transferase enzyme epsB family |
| 6 | 92 | epsD | Peptidyl-prolyl cis-trans isomerase, EpsD family |
| 7 | 93 | epsE | Polysaccharide export protein EpsE |
| 8 | 94 | epsF | Chain length determinant protein EpsF |
| 9 | 95 | epsG | Chain length determinant protein tyrosine kinase EpsG |
| 10 | 96 | epsH | Exosortase B |
| 11 | 97 | epsI | EpsI family protein |
| 12 | 98 | N/A | Polysaccharide biosynthesis protein |
| 13 | 99 | N/A | Polysaccharide pyruvyl transferase |
| 14 | 100 | N/A | Nitroreductase |
| 15 | 101 | N/A | O-antigen polymerase |
| 16 | 102 | epsJ | Glycosyl transferase, family 2 |
| 17 | 103 | N/A | Glycosyl transferase, family 2 |
| 18 | 104 | N/A | Glycosyl transferase, group 1 |
| 19 | 105 | N/A | Glycoside hydrolase, family 5 |
| 20 | 106 | N/A | Glycosyltransferase, RfaG |
| 21 | 107 | N/A | Mannose-1-phosphate guanylyltransferase (GDP) |
| 22 | 108 | N/A | dTDP-4-dehydrorhamnose reductase |
| 23 | 109 | N/A | dTDP-4-dehydrorhamnose 3,5-epimerase |
| 24 | 110 | N/A | Glucose-1-phosphate thymidylyltransferase |
| 25 | 111 | N/A | dTDP-glucose 4,6-dehydratase |
| 26 | 112 | epsS | UDP-galactose 4-epimerase |

TABLE 2

| ORFs of EPS gene cluster 2 in *M. flagellatus* | | | |
|---|---|---|---|
| Amino acid sequence SEQ ID NO | Nucleotide sequence SEQ ID NO | S12 homolog | Predicted function/property |
| 27 | 113 | N/A | Mannose-6-phosphate isomerase, type 2 |
| 28 | 114 | N/A | ABC transporter permease |
| 29 | 115 | N/A | NDP-hexose 3-C-methyltransferase TylCIII |
| 30 | 116 | N/A | GDP-mannose 4,6-dehydratase |
| 31 | 117 | N/A | NAD-dependent epimerase/dehydratase |
| 32 | 118 | N/A | Glycosyl transferase |
| 33 | 119 | N/A | Polysaccharide export protein |
| 34 | 120 | N/A | Glycosyl transferase |
| 35 | 121 | N/A | NAD-dependent epimerase/dehydratase |
| 36 | 122 | N/A | Sugar transferase |
| 37 | 123 | N/A | Polysaccharide biosynthesis protein CapD |
| 38 | 124 | N/A | UDP-glucose pyrophosphorylase |

TABLE 3

| ORFs of EPS gene cluster 2 in *M. glycogenes* | | | |
|---|---|---|---|
| Amino acid sequence SEQ ID NO | Nucleotide sequence SEQ ID NO | S12 homolog | Predicted function/property |
| 39 | 125 | epsA | Transcriptional regulator, LuxR family |
| 40 | 126 | epsL | Exosortase B-associated extracellular polysaccharide biosynthesis transporter EpsL |
| 41 | 127 | N/A | Undecaprenyl-phosphate glucosephosphotransferase |
| 42 | 128 | epsD | Peptidyl-prolyl cis-trans isomerase, EpsD family |
| 43 | 129 | epsE | Polysaccharide export protein EpsE |
| 44 | 130 | epsF | Chain length determinant protein EpsF |
| 45 | 131 | epsG | Chain length determinant protein tyrosine kinase EpsG |
| 46 | 132 | epsH | Exosortase B |
| 47 | 133 | epsI | EpsI family protein |
| 48 | 134 | epsB | Glycosyltransferase |
| 49 | 135 | N/A | Oligosaccharide repeat unit polymerase |
| 50 | 136 | N/A | Right-handed parallel beta-helix repeat-containing protein |

TABLE 3-continued

ORFs of EPS gene cluster 2 in *M. glycogenes*

| Amino acid sequence SEQ ID NO | Nucleotide sequence SEQ ID NO | S12 homolog | Predicted function/property |
|---|---|---|---|
| 51 | 137 | N/A | Acyltransferase family protein |
| 52 | 138 | N/A | Glycosyltransferase family 4 protein |
| 53 | 139 | N/A | Glycosyltransferase family 4 protein |
| 54 | 140 | N/A | Nucleotide sugar dehydrogenase |
| 55 | 141 | epsR | Unknown |
| 56 | 142 | N/A | Unknown |
| 57 | 143 | N/A | Oligosaccharide flippase family protein |
| 58 | 144 | N/A | Polysaccharide pyruvyl transferase family protein |
| 59 | 145 | N/A | Acyltransferase |
| 60 | 146 | epsQ | mannose-1-phosphate guanylyltransferase/mannose-6-phosphate isomerase |

TABLE 4

ORFs of EPS gene cluster 2 in *M. glycogenes*

| Amino acid sequence SEQ ID NO | Nucleotide sequence SEQ ID NO | S12 homolog | Predicted function/property |
|---|---|---|---|
| 61 | 147 | N/A | MarR family EPS-associated transcriptional regulator |
| 62 | 148 | N/A | GDP-mannose 4,6-dehydratase |
| 63 | 149 | N/A | NAD-dependent epimerase/dehydratase family protein |
| 64 | 150 | N/A | Unknown |
| 65 | 151 | N/A | Polyhydroxyalkanoate synthesis repressor PhaR |
| 66 | 152 | N/A | UDP-N-acetylglucosamine 2-epimerase (hydrolyzing) neuC |
| 67 | 153 | N/A | Imidazole glycerol phosphate synthase subunit HisF |
| 68 | 154 | N/A | Imidazole glycerol phosphate synthase subunit HisH |
| 69 | 155 | N/A | N-acetyl sugar amidotransferase |
| 70 | 156 | N/A | Polysaccharide pyruvyl transferase family protein |
| 71 | 157 | N/A | Acyltransferase |
| 72 | 158 | N/A | Unknown |
| 73 | 159 | N/A | ABC transporter ATP-binding protein |
| 74 | 160 | N/A | FkbM family methyltransferase |
| 75 | 161 | N/A | Glycosyltransferase |
| 76 | 162 | N/A | Methyltransferase, TIGR04325 family |
| 77 | 163 | N/A | NAD-dependent epimerase/dehydratase family protein |
| 78 | 164 | N/A | DegT/DnrJ/EryC1/StrS family aminotransferase |
| 79 | 165 | N/A | Glycosyltransferase |
| 80 | 166 | epsJ | Glycosyltransferase |
| 81 | 167 | N/A | Glycosyltransferase |
| 82 | 168 | N/A | Glycosyltransferase |
| 83 | 169 | N/A | SDR family oxidoreductase |
| 84 | 170 | N/A | Sugar transferase |
| 85 | 171 | N/A | SDR family NAD(P)-dependent oxidoreductase |
| 86 | 172 | epsT | UTP--glucose-1-phosphate uridylyltransferase GalU |

TABLE 5

Full sequences of clusters

| SEQ ID NO | Organism | Cluster | Strand |
|---|---|---|---|
| 173 | *M. flagellatus* | 1 | top |
| 174 | *M. flagellatus* | 1 | bottom |
| 175 | *M. flagellatus* | 2 | top |
| 176 | *M. flagellatus* | 2 | bottom |
| 177 | *M. glycogenes* | 1 | top |
| 178 | *M. glycogenes* | 1 | bottom |
| 179 | *M. glycogenes* | 2 | top |
| 180 | *M. glycogenes* | 2 | bottom |

ORFS annotated as epsD, epsE, epsF and epsG (SEQ ID NO: 6-9 in *M. flagellatus*, SEQ ID NO: 42-45 in *M. glycogenes*) were chosen for deletion, based on their similarity to EPS-production essential genes in *Methylobacillus* sp. strain 12 (Yoshida et al., 2003). Since the second EPS cluster had no clear homologues in other characterized EPS clusters, all 12 ORFS in *M. flagellatus* (SEQ ID NO: 27-38) and all 26 ORFS in *Methylobacillus glycogenes* (SEQ ID NO: 61-86) were chosen for deletion.

Example 2: DNA Deletions

Modified strains of ABME 5 and ABME 6 were preparing in which either one EPS-producing cluster or both EPS-producing clusters are deleted. The genome edits were achieved by introducing a linear DNA fragment consisting a kanamycin or rifampicin resistance cassette flanked by 2 kb long sequences upstream and downstream of the integration sites. DNA fragments were transformed into ABME 5 and ABMR 6 by electroporation. Transformations were plated onto selective PM7 plates containing 20 g/L agar, 50 μg/mL kanamycin, or 5 μg/mL rifampicin for 24-48 h. ABME 5-derived strains were incubated at 30° C. ABME 6-derived strains were cultivated at 37° C. Correct clones were confirmed by colony PCR. The strains prepared by DNA deletion are listed in Table 6.

TABLE 6

| List of strains prepared with genomic integration. | | | |
|---|---|---|---|
| Strain | Species | Genotype | Deleted sequences |
| ABME 5 | *Methylobacillus glycogenes* DSM 5685 | Wild type | |
| ABME 76 | *Methylobacillus glycogenes* DSM 5685 | epsDEFG :: kanR | SEQ ID NO: 181 |
| ABME 190TH | *Methylobacillus glycogenes* DSM 5685 | EPS2 :: kanR | SEQ ID NO: 182 |
| ABME 191TH | *Methylobacillus glycogenes* DSM 5685 | epsDEFG :: kanR, EPS2 :: rifR | SEQ ID NO: 181 and SEQ ID NO: 182 |
| ABME 6 | *Methylobacillus flagellatus* DSM 6875 | Wild type | |
| ABME 80 | *Methylobacillus flagellatus* DSM 6875 | EPS2 :: kanR | SEQ ID NO: 184 |
| ABME 82 | *Methylobacillus flagellatus* DSM 6875 | epsDEFG :: kanR | SEQ ID NO: 183 |
| ABME 131 | *Methylobacillus flagellatus* DSM 6875 | epsDEFG :: kanR, EPS2 :: rifR | SEQ ID NO: 183 and SEQ ID NO: 184 |
| ABME 145 | *Methylobacillus* sp. DSM 1758 | Wild type | |

Example 3: Measurements of Total EPS in Shake Flask Cultures Before and After EPS Gene Disruption in *Methylobacillus flagellatus*

To evaluate the effects of deleting EPS-producing genes in ABME 6, three modified ABME 6 strains (ABME 80, ABME 82 and ABME 131) were prepared as described in Example 3 and tested for EPS production.

Confirmed transformants were grown overnight on PM7+50 μg/mL kanamycin agar plates. Single colonies were resuspended in 25 mL PM7 medium+25 μg/mL kanamycin in baffled 250 mL shake flasks, and incubated overnight at 200 rpm. Next day, 50 mL PM7 medium+25 μg/mL kanamycin in baffled 250 mL shake flasks was inoculated with 2.5 mL overnight culture. All ABME 5-derived strains were cultivated at 30° C., and all ABME 6-derived strains were cultivated at 37° C. The cultures were then chilled on ice, aliquoted into 2 mL Eppendorf tubes and centrifuged for 15 minutes at 15 000 rpm on a standard tabletop centrifuge at 4° C. When a layer of EPS was visible above the cell pellet, it was mixed back into the supernatant. The culture supernatants were stored for EPS hydrolysis. Hydrolysis was performed by adding half the volume of the supernatant of 6M TFA (trifluoroacetic acid), resulting in a final TFA concentration of 3M. Tubes were placed into a thermoblock heated to 120° C. and incubated for 6h. After hydrolysis, the liquid (including TFA) was evaporated at 80° C. until completely dry. The dry mass was resuspended in 0.5 M NaOH (at the same volume as the original culture aliquot) and analyzed for monomeric sugars on an HPLC.

TABLE 7

| Composition of PM7 medium used for shake-flask experiments | |
|---|---|
| Compound | Per 1 L |
| MeOH | 10 g |
| KH2PO4 | 0.65 g |
| NA2HPO4 | 1.05 g |
| MgSO4 * 7H2O | 0.1 g |
| NH4Cl | 0.2 g |
| (NH4)2SO4 | 2 g |
| TE1 1000X | 1 mL |
| d-Biotin | 0.1 mg |
| Thiamine*HCl | 0.1 mg |
| Riboflavin | 0.1 mg |
| Pyridoxine*HCl | 0.1 mg |
| Pantothenate | 0.1 mg |
| Nicotinamide | 0.1 mg |
| p-Aminobenzoic acid | 0.02 mg |
| Folic acid | 0.01 mg |
| Vitamin B12 | 0.01 mg |
| Lipoic acid | 0.01 mg |
| CaCl2 * 2H2O | 3.3 mg |
| FeSO4 * 7H2O | 1.3 mg |
| MnSO4 * H2O | 0.1 mg |
| ZnSO4 * 7H2O | 0.13 mg |
| CuSO4 * 5H2O | 0.04 mg |
| Na2MoO4 * 2H2O | 0.04 mg |
| CoCl2 * 6H2O | 0.04 mg |
| H3BO3 | 0.03 mg |
| pH | 7.0 |
| Agar (for solid media) | 20 g |

ABME 6 produced a visible slime layer on top of the cell pellet after centrifugation, amounting to ~1 g/L total monomeric sugars after hydrolysis. The single-cluster disruptions (ABME 80 and ABME 82) had no visible slime layer, but still produced ~500 mg/L total sugars. Interestingly, the glucose to total sugars ratio is inverted depending on which gene cluster was disrupted, most likely due to two different types of EPS being produced. When both clusters were disrupted (strain ABME 131), sugars were below the detection limit.

Example 4: Measurements of Viscosity in Reactor Cultures of *Methylobacillus flagellatus* before and after EPS Gene Disruption To assess the change in fermentation broth viscosity before and after the disruption of EPS production, the strains were compared in 5-liter bioreactor fermentations under oxygen limitation. The bioreactor seed cultures were always prepared as follows. 25 mL of PM7 medium in 250 mL baffled shake-flasks were inoculated with 250 uL of strain cryo-stock with the stock OD adjusted to 5, to produce a starting OD of 0.05. The cultures were incubated overnight at 200 rpm 37° C. In the morning, 200 mL of PM7 medium in 2 L baffled shake-flasks was inoculated with 10% (20 mL) of the overnight culture and grown until OD ~1 (+/−0.2). The culture was then used to inoculate a 2.5 L starting volume of sterile PM3 medium in 5-L bioreactors (8% inoculum). The pH was kept at 7 by automatic addition of $NH_4OH$ and the temperature was kept at 37° C.

Figure 2:
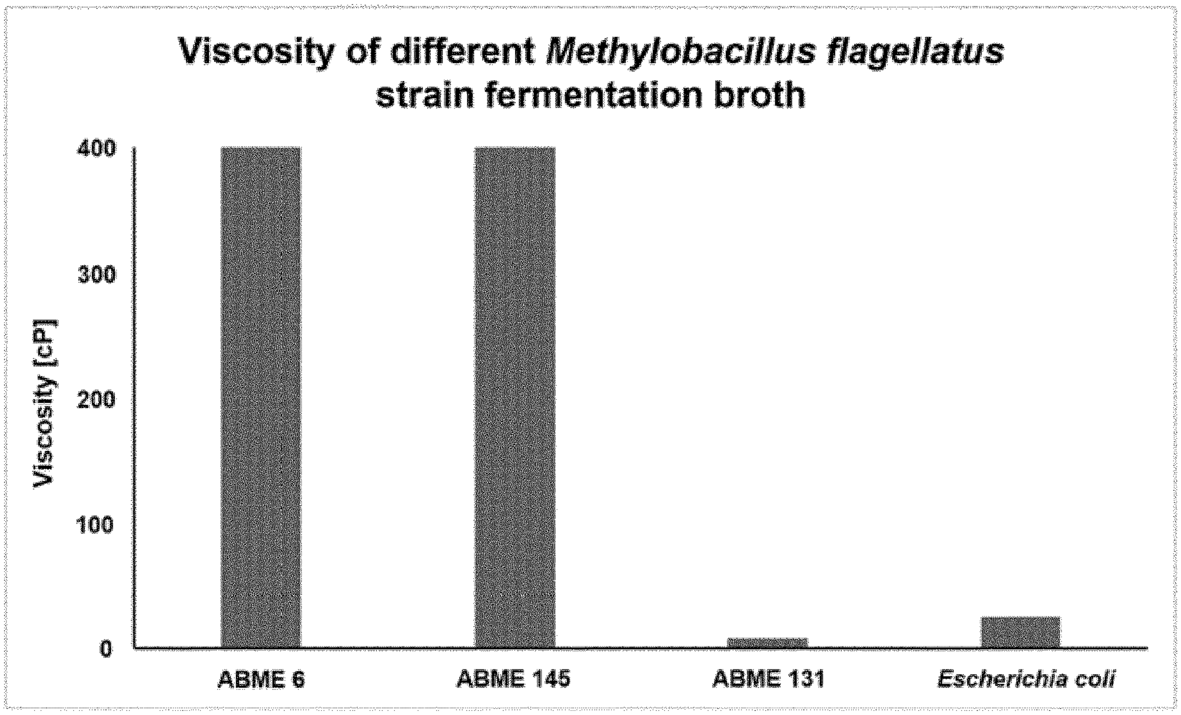
FIG. 2: Measured viscosity of bioreactor broth produced by different strains of *Methylobacillus flagellatus.*

For oxygen limited processes, methanol was fed automatically to maintain a concentration between 3 and 6 g/L. Reactor aeration and stirring were kept at maximum, though the oxygen concentration always dropped to 0% during the process. The broth was sampled regularly for OD, mineral and metabolite measurements. Viscosity was measured at the end of the process and the results are summarized in FIG. 2. Wild type *M. flagellatus* fermentation broth was highly viscous at the time of sampling at 400 centipoise. A different species of *Methylobacillus*, ABME 145 was measured as well and produced a similarly viscous broth of 422 centipoise. The double disruption produced a visibly less viscous broth, which could be centrifuged and filtered using standard tabletop equipment—something that was not possible with the previous samples. The viscosimeter confirmed this assessment, measuring in at 35 cP or a nearly 10-fold reduction in viscosity. A representative sample of *Escherichia coli* fermentation broth was also measured for comparison.

Example 5: Measurements of Reduced Foaming in Shake Flasks Before and After EPS Gene Elimination in *Methylobacillus flagellates*

We observed that the EPS-deficient strains showed significantly less foaming. To compare foam formation of ABME 6 against EPS-deficient mutant strains (ABME 82 and ABME 131), the strains were culture as described in Example 3.

Figure 3:
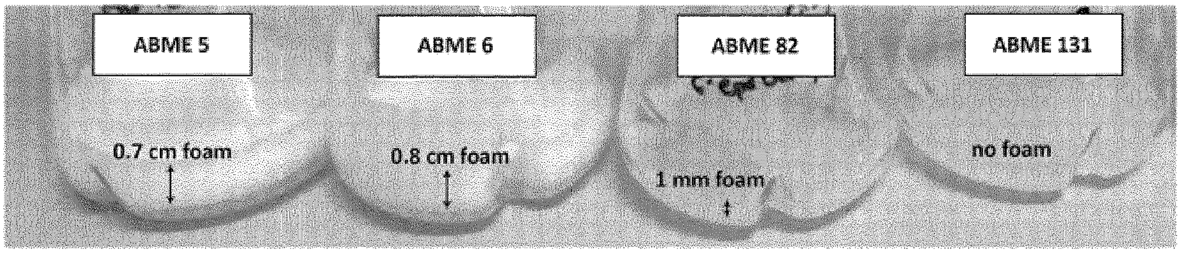
FIG. 3: Photo of wild type *M. flagellatus* and *M. glycogenes* cultures after 24 hours of incubation. Wild type ABME 5 and 6 on the left, followed by a single-cluster disruption in *M. flagellatus* and finally a double disruption.

To measure foam formation flasks were taken off the shaker and the liquid was allowed to settle for 5 minutes. The foam layer on top of the liquid was measured with a tape measure (FIG. 3). Wild type cultures produced 0.5-1 cm of foam layer on top of the liquid while the single-cluster disruptions only accumulated ~1 mm of foam at the liquid meniscus. No foam at all was visible in the double-disruption cultures.

Example 6: Measurements of Reduced Foaming in Bioreactor Cultivation Before and After EPS Gene Disruption in *Methylobacillus flagellatus*

To assess the change in fermentation broth foaming before and after the disruption of EPS production, the strains were compared in 5-liter bioreactor fermentations. The amount of foam formation was approximated by the amount of added anti-foaming agent (SAG 5693). The fermentations were carried out under carbon limitation.

Figure 4:
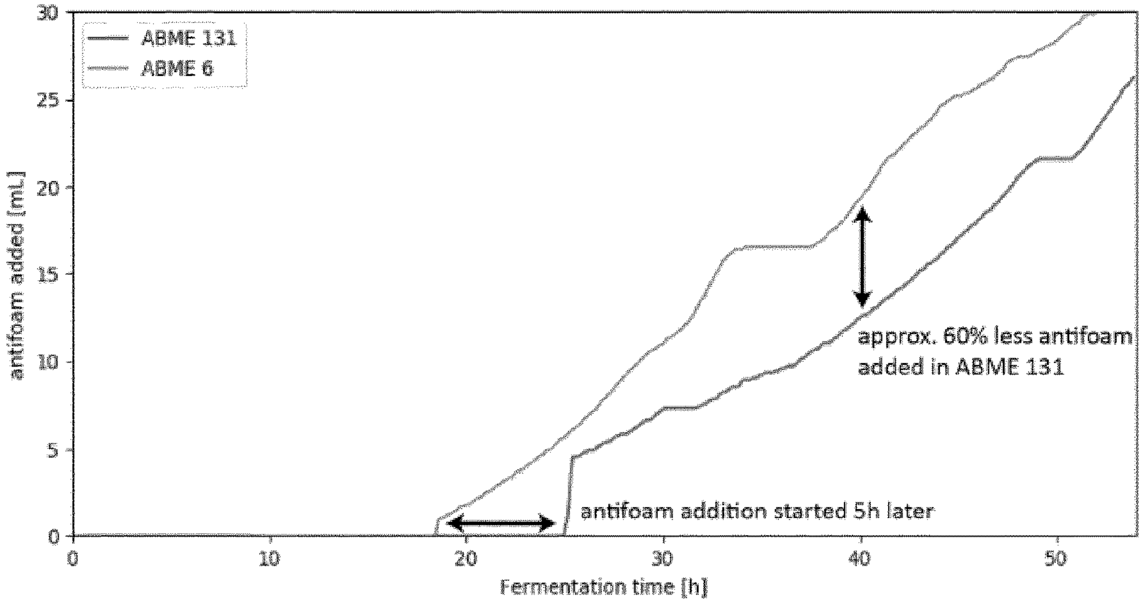
FIG. 4: Plot of antifoam addition (y axis) during two representative bioreactor fermentations of ABME 6 and ABME 131 in relation to fermentation time (x axis).

The reactors were inoculated as described in Example 5. To achieve carbon limitation, 50% methanol was fed to the reactor automatically at a dynamically-calculated rate that that maintained pO2-value at approximately 30% at the highest aeration and stirring settings. The added methanol was consumed immediately and kept below detection levels. Antifoam was added automatically when foam reached a detector placed above the fermentation broth meniscus. ABME 6 and ABME 131 were tested in this way. Antifoam addition started 5 h later in the case of ABME 131. Approximately 60% less antifoam was added in the ABME 131 fermentation, depending on the fermentation time (FIG. 4).

Example 7: Microscope Images of *Methylobacillus flagellatus* Cell Aggregates before and after the EPS Gene Disruption To assess the change in cell clumping foaming before and after the disruption of EPS production, the strains were cultured in 5-liter bioreactor fermentations under oxygen limitation as described in Example 3.

Figure 5:
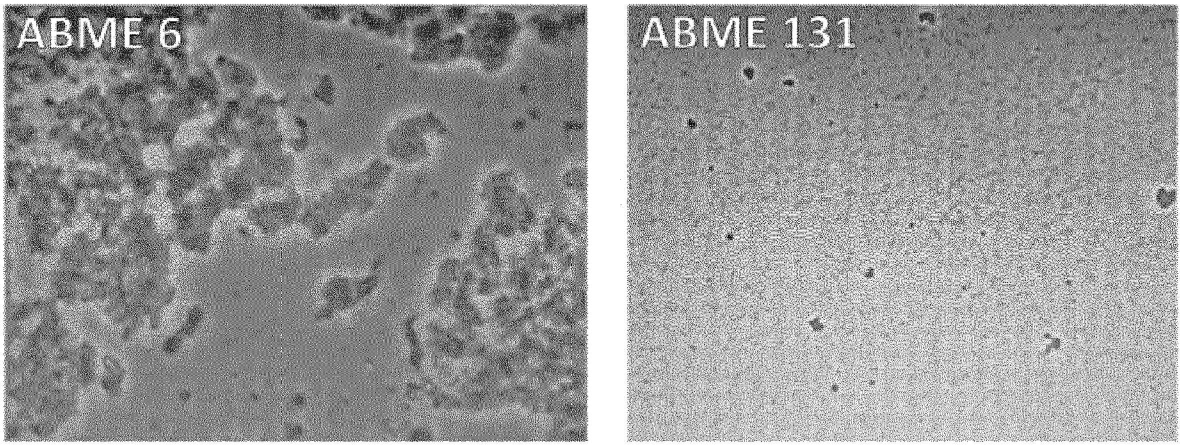
FIG. 5: Phase-contrast microscopy images of bioreactor fermentation broth of wild type *Methylobacillus flagellatus* (left) vs the double-disruption strain ABME 131 (right).

Samples of broth were observed by phase-constrast microscopy on a Zeiss Axioplan 2 microscope through a Zeiss Ph2 Plan-NEOFLUAR 40× objective (NA 0.75) and recorded on a sCMOS camera. Cells of ABME 6 formed large clumps, and were immobilized in the EPS matrix (FIG. 5). In the case of the double-disruption strain ABME 131, cells floated individually in solution, with minimal clumping.

Example 8: Improved Methanol Tolerance of EPS-Free *M. flagellates*

Tolerance to high methanol concentrations is a critical parameter for efficient bioprocesses. To confirm that methanol tolerance was not reduced in strains that cannot produced EPS, growth at increasing methanol concentrations was tested in ABME 6 and its EPS-producing derivative strain ABME 131.

The strains were tested in shake flasks as described in Example 4. To test methanol tolerance, the initial methanol concentration was increased up to 4.5%. OD600 was measured after 24 h.

Figure 6:
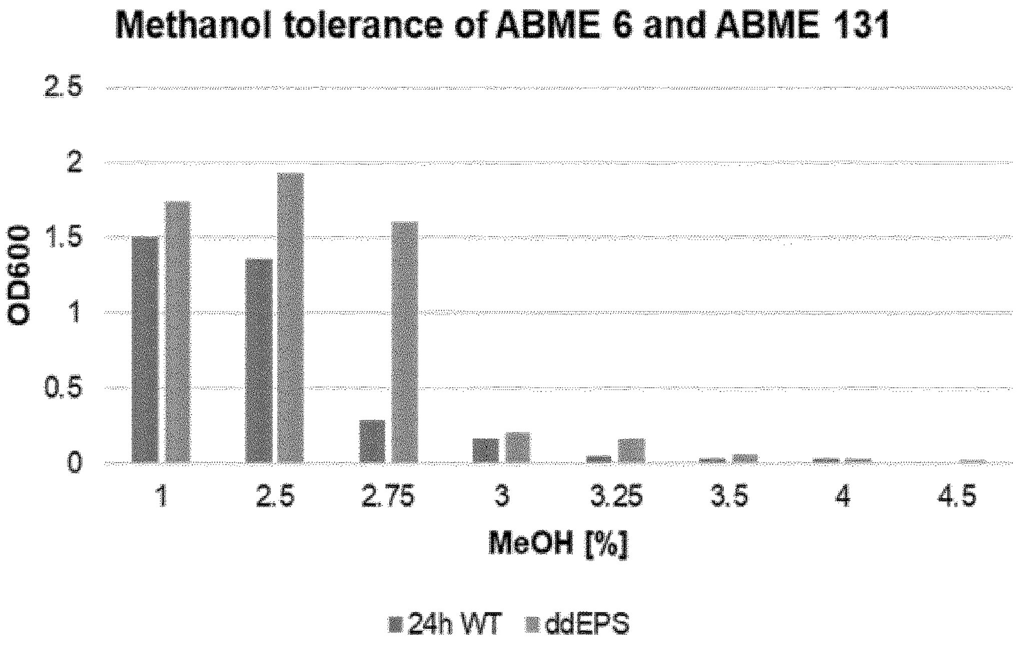
FIG. 6: Improved growth of the EPS free ABM E131 compared to the parent strain.

Surprisingly, the methanol tolerance of ABME 131 was higher compared to ABME 6. For example, at 2.75% initial methanol concentration, the EPS-free ABME 131 grew to an OD600 of 1.6, whereas the wild-type ABME 6 only grew to an OD600 of 0.3. The difference in growth was most striking at 2.75%. However improved growth of ABME 131 compared to ABME 6 was apparent at all methanol concentration (FIG. 6).

LIST OF REFERENCES CITED IN THE DESCRIPTION

Chistoserdova, L. et al. (2007) 'Genome of *Methylobacillus flagellatus*, Molecular Basis for Obligate Methylotrophy, and Polyphyletic Origin of Methylotrophy', *Journal of Bacteriology*. American Society for Microbiology Journals, 189(11): 4020-4027.

Hattori, M. et al. (2020) *Methylobacillus glycogenes JCM* 2850, *whole genome shotgun sequencing p—Nucleotide—NCBI.*

Yoshida, T. et al. (2000) 'Saccharide production from methanol by transposon 5 mutants derived from the extracellular polysaccharide-producing bacterium *Methylobacillus* sp. strain 12*S', Applied Microbiology and Biotechnology*. doi: 10.1007/s002530000407.

Yoshida, T. et al. (2003) 'Genes involved in the synthesis of the exopolysaccharide methanolan by the obligate methylotroph *Methylobacillus* sp. strain 12*S', Microbiology*. Microbiology Society, pp. 431-444. doi: 10.1099/mic.0.25913-0.

Qui Z and Goodman M F: The *Escherichia coli* polB locus is identical to dinA, the structural gene for DNA polymerase II. Characterization of Pol II purified from a polB mutant. J Biol Chem. 1997, 272(13): 8611-8617.

Kwon D H, Peña J A, Osato M S, Fox J G, Graham D Y, Versalovic J: Frameshift mutations in rdxA and metronidazole resistance in North American *Helicobacter pylori* isolates. J Antimicrob Chemother 2000, 46(5): 793-796

Datsenko K A, Wanner B L: One-step inactivation of chromosomal genes in *Escherichia coli* K-12 using PCR products. Proc Natl Acad Sci U.S.A. 2000, 97:6640-6645.

SEQUENCE LISTING (184 sequences)

SEQ ID NO: 1 - protein, 257 aa, Methylobacillus flagellatus
MSLNKNLNDIEKSQLIELMHESLRIRSHFELFLWMQGKLQVFLPHEIMITAWGDFSLGVIYFNIVSPLPGIRSDKIASHEINQFLQNLFNYWLNHAKAPFTLAAADNILHDCEFSNKESSYYLKNMKSALVHAIKDHRGRHDCLYVLLSSNLSFPPASRPMLEALLPYIDSALRQIEHLPEQQPTLIKAEPEPKDESLNILSGRELEIMDWVTKGKTNQEIGMILDISAFTVKNHLQRIFKKLNVMNRAQAVAKFRK

SEQ ID NO: 2 - protein, 168 aa, Methylobacillus flagellatus
MYPDLVHLGGADKYFEEILEIVNKIKLFGDFSNEEVRYLCSYMQCYAAPRDCQLLTEGDPGDYLLLILTGEVNVIKDIPNKGIQTIAKVGAGAIIGEMSMIDGMPRSASCVASLPTDFAVLSRDALYQLLANMPKLGNKVLIRLLQLLTARFRESYDRILPKTLGELI

SEQ ID NO: 3 - protein, 225 aa, Methylobacillus flagellatus
MFLSRLHTPILSRVAPFALYMLFMAVVDLVVRIGLVDADTRWLYGIKVGLVALLLWYLRKQYVELQGLAALGARSWLSAIAVGMLVFIAWINLDAPWMLIGDQSEGFDPGSGPDARLLMATRVMGAALVVPLMEELFWRSFLMRWIHNQHFLNVDPRQVSVLALLVSSALFAIEHTEWFAGLVAGLAYGLLYIRSGKIWLPIIAHAVTNGILGLWIIYTGNWHYW

SEQ ID NO: 4 - protein, 410 aa, Methylobacillus flagellatus
MRLSQSTNLIKIALVAGLGIELAGFVVPACALEGDVLKPYASLTYSYDDNLRRFASKQLAQMSTGSSDTSDTMLVKSAGIVLDHTISRQKMYVDFRLNKSTFNKNSELDNDGRDVIARWDWELGNRLEGKVEFFHKKALVPFSEFQPLQGTMLSLNTRTQDRRLLEARWMLHPRWRVRGAFIYSEMEYGAEAQRAANLKEDIQEIGFDYLSPTKSIIGVLYRNTKGSKPQQAFQGSFISNDYDQNELKLNVDWAVTGKSRLQFLGGLVDRQHEQLSQRDFRGVNARGNFNWMTSGKTNLNAAVWRENNAQSFVTTSYTLNRGTSLTANLQATGKIAVQGVLKYEKRDFEGDQIFGQFRSDKDKSFMLSLMYNPVTSFRITTSFIHSDRESTSDMFEFRSNSVSVTGQYEF

SEQ ID NO: 5 - protein, 461 aa, Methylobacillus flagellatus
MTVNDIPLVAFFKQLLDPLIILGTLYGFTLLYGEPFNGYYLILALLAYFVSSNVYERLDLYRTWRSGKVLGYIRDILFGWAIVVTILAFIGYAADLTDQYHEEMVYTWFVAVPIIFTVAHLLIRKIASDLHKNGEVRSVVIVGANDIGVRLVNRINEDPYLFMEVKGLFDDREISRHPKGMRHVPLLGTMADVAAYVRANNTQIIFISLPMSAQPRIRQLFEELQDTTASVYFVPDIYIFDLVQARFDDVAGVPVVAICETPFTGFNSLIKRTSDIILASLILLLLSPIMLTLALAVKLTSKGPVIFKQRRYGLNGEEIIVYKFRSMTVMEDGDKVVQAQKRDQRLTPIGGFLRRNSLDELPQFINVLQGRMSIVGPRPHAVAHNEQYRKLIRGYMLRHKVKPGITGWAQVNGLRGETDTLEKMEARIEYDLDYLRHWSLAFDLWIIIRTVLVVFKKDNAY

SEQ ID NO: 6 - protein, 314 aa, Methylobacillus flagellatus
MNTEYGSTIMQWSKMTKGALVALMISIGLSGCGDKSNETKASQSLARVNGKEITVHQLNEELARANVQPAQKEAATKQILQSLIDRQLLEQAALKAKVDRDPNVMQAIERAKSQMIAQAYLQSRVANIGKPDKTEVENFYKQNPQLFSERKLVEMEQILIDSRYVNDEFKSALGSFKTLQEVAAWLDAKGIQYDRGEVARSVAELPPQISERLKDARRGQLFVIGMGPRTMLVLMDSVKESPVSLADATPQIEQMLLNKKRKEAGEAEIKRLRAEAKIEYLDKSAEVPQQPEKAEQSKPSSVDDDIARGVSGLK

SEQ ID NO: 7 - protein, 270 aa, Methylobacillus flagellatus
MYRCSAMTKLIKWFVTVVLTIVVFNVNAADSDIVLGPGDVLRISVFEQPDLSLEVRVSESGTITYPLIGEVRVGGETPAAAERKIASMLESGGFLKNPHVNIIVAQLQSQQVSVLGQVNRPGRYPLDSAKSLADVLALAGGVAPDGGDLISLVRKIEGKSVREIIDFAEMMRDGDLNKNILLTAGDIIYVDRAPRFYIYGEVQRPGQYRLEYHMTVLQALAVGGGLSLRGTEKGIKVKRLDDEGGVKIIKVKHDDFIQPNDVVYVQESVF

SEQ ID NO: 8 - protein, 469 aa, Methylobacillus flagellatus
MSFIRFISIIKARYKIIIFTLFITVLTTAIVTILLPKNYKATASVLVNYKGADPVTGVMLPAQLMPGYMATQVDIISSKNVAKKVIDKLGLADVPAVKEDFYQATSGKGEIKEWLADLLLKKLQVKPSRESSIIDISFFGVNPQFAATIANEFAESYMQTSIQLKVEPSQKAALYFVEQLKELREDLAQAQSKLSEYQQEKGIVSVDERLDVERARLNELSSQLVIAQAQVMEARSREKNSSGKEAYESPDVAANPIIQNLKTEIARAESRFADVSQKFERNHPFYLGAKAEIENLKSELDRQIKSVSSNVASNSRILQQREAEIRLALNNQKEKVLQLNRDRDILSVLTREVENAQKAYDMAMQRYTQTNIEGQSNQSDISLLNPAVAPLTPTSPNLLLNIILSILLGMFLGIGFGVLAEFVDRRVRTADDLIEVLQAPLLGTISKEKRKLRFFKNTSNLITLGKAEL

SEQ ID NO: 9 - protein, 298 aa, Methylobacillus flagellatus
MISFTPSNSNSEKVENAPLVNEFSEFTIGSLLLRMGKITPEDAERIMRLHKEKGLRFGEAAQALGLITEDDIQQVLSRQFNYPYLSPDQNSYLNELVAAYQPFSNKAEVLRAVRSQLMLHWFSPERKALAVSSVSSSDNASSFVANLAVVFAQLGENTLLIDANLRYPRQHEIYNLSNKRGLSDILAGRAGYDVISKINFFENLSVLTAGTLPPNPQELVSKPTFGNLIKELACVYDVILLDTPELSNYSDGYAIAFTVGGIVLVARQNHTRVNDLSIAVEQCKNNGTKVIGSILVDL

SEQ ID NO: 10 - protein, 295 aa, Methylobacillus flagellatus
MNTVEVIEQDNPGIWEVINRNWMLLLGLFIMYTPTYLNLLNTVWQSEDQAHGPLIVGVVLYLVWVQRHQLFKAENNIIGRPVIGGIVLVFGLLLYILGRSQDIAPLDIASQIPVFAGLLLIFRGYSGLRALWFPLFFLIFMVPLPGVFLDAVTLPMKIAVSYVAENILYWIGYPISRSGVILQIGQYQLLVADACAGLHTLISLEALGLLYLNVVKHDSFIRNVILGILIIPISFTANVIRVMVLTLVTYHFGDAAGQGFVHGFAGMLLFVVALILIISVDTLLQYLVKKWQLKA

SEQ ID NO: 11 - protein, 226 aa, Methylobacillus flagellatus
MDGFTLRNLIIFLLLLVATLGGVILKPTKFVNAAEDINLEAMIPKEFDEWKIDPTITPIQVSPEVQQNLNKVYDQTLSRTYINKQGMRIMLSIAYGGDQSRGLQAHKPETCYTAQGFNVDLLGNAILNFDGYEIKVRHLLAQHGARYEPILYWMRVGETTVYGGLGQTIKRFELGLQGYIPDGLLFRVSSISRDNISAFTLQEEFVKSLLKNVDSKSRKKLIGTFS

SEQ ID NO: 12 - protein, 428 aa, Methylobacillus flagellatus
MIKHTAFMALSTFSRLLSAVVLFIILARFLGPRDFGILMYNFTLASIAVLLVEYGFSNQLLRDIGRYPDNINQLMGRVFLAKLYLTVVMGVCCLAGHYLFYTNDLDRAIFWILLLSCLLTSFGDFFNIAFRGIGKFHEETKVATIGSLLHFGLIVLMVINGAELLLISLGFVLSRFVYFILSWRAYKRVVGDLNTLSASPVAVLKALKAGFPYAVDAGFTNFFYQVDTMLVKYYLGATGVGIYQAGMRFLNGAMQFAPVLGNVFLPVIAAKHTNTREFVELAKKLNLQMLAVGTVCWAIFWFAGMHITEFVFGDEYVELNSIWPYIGLLVFTRYLAAPQGVLLTASGSQTIRVWAQIFALIILLISAPLLMKVIGLKGMVIALIITLLTLFLIFFSALRLRKIPTGFGGVNFTLTVIVFSLSIFLLVY

SEQ ID NO: 13 - protein, 392 aa, Methylobacillus flagellatus
MLKIGLLWHSTTSDNLGVGALTEAQISIINKAAVQAGVEVEYRIFGTNGNKDYFEGNPLIERGTNVSLKRILIGASDYPKKIRECDVVFDIGEGDSFADIYGFSRFLIQIVSKLVVLFQRKPLILSPQTIGPFESRFNLKVANNVMQRCTKIFVRDGLSFGYLQKNNLSVNAEEVIDVAFRLPFQRPSRDSSKVKIGLNVSGLLYNGGYTGKNQFGLSVNYPELTRSLLDQFTRIEGCEVWLVPHVLTTSFPIEDDVNVCVQLQELYPAAKLAPSFSSPSQAKSFISGMDFFLGARMHACIAAFSSGVPVVPLAYSRKFNGLFSALDYPYLGDCKVNTNEQIVGLVMDCFNSREQLKFAVEEGNKIAEKKLLRYEQYIAELLTRISNKKIVL

SEQ ID NO: 14 - protein, 340 aa, Methylobacillus flagellatus
MYSCKMKKYIIGFLPLSIKWLLRFCLRGPSLLRDFCYDAKRYIKWSSVISFEKDREKILAVITATYHNIEKGMSLPNPRPLFGRVVIGQLVGSVDNFHLNFGPDPQLDVPINVLARYCQFNRSLGQPDSQLEVIVDRLKKNNQSTLLRINDGGVILRSKAEVLDAISGVKEDFFLMRHSVRQFTKDPIEHSVIEKAVRIAQKSPAVCNRQSGKVRAILNPELIRSTLQIQGGARGFYEEVQALFCITVDLSNFNGAERYQGWIDGGMFAMSFIYGLHLQGLGSCALNWSKTRKQDIEMRNHLRIPENELIIMFVAAGYLRESFVVPQSYRKPLGEVLSYI

SEQ ID NO: 15 - protein, 490 aa, Methylobacillus flagellatus
MKNNSSLLSFNRRDANFVSLKIGSIFFVIMAAIVALIFGFVSAIFPWWWIVAIILSILFIFIGFTYPLVALIAVIAISSRLIPDTFLPSIRLLGGTIPSSDMALFATFIFCFFKYNSEFSFTKQALSPLAIPLFVVLLLLLFSVFRAVFEIRLPLKDILGESRHFLYWLLIPLIALTCSDRQRFKFIVFGFLFVAFLFSIGQILQGFLGVNVFGRELTSLETLGSINSDVTRSMTSGTHIIVWGFLFVLALFANRIGFSKTLIILCIFTGAGIFLTYGRAVWGGTFLAVLFLCWKLGTKKMLRSVGLIAIVAVFGLSAMLAIKPGAIEGAMQRLFSVEEEVSHGSSLGWRFYENKMAWAAIQRSPLLGIGLGAPYRPPAKSDVTAEQVRYVHSAYIYLTLKTGIIVFMSVIFLIFKILHLTYIQTRSNDLFISSVAIASFAAMIEYFLACITQPELMQTPGIAFLATLAGLMCAANYLNQKNLTKGKLTS

SEQ ID NO: 16 - protein, 268 aa, Methylobacillus flagellatus
MNVKTSPLISIITATYNSMKYFEDTKKSVLEGDVEDFEWIIVDDGSTDGTRKYLQEIDHPNIKLHFKSINAGIEDSYRTGIELATGKYLLILDHDDTIPLGSLSKRLDLLESNPNALAAFGAVAYMDESGRIYKESRFPFVSDDCVLSSLFTLFGIFILPVYPLKQGCVVLRSSFVKNNPGLYDIQLFLQAAKLGPVIFIKQACLNYRTFRTQFSSSRKMRLIRFFQFVWAKYAFKFLPWYISPFFAIYKTIPEFFKVLWSFVSSKRI

SEQ ID NO: 17 - protein, 322 aa, Methylobacillus flagellatus
MMTDFSSKKKLDLSVAIVFVNYNTSDQIISCIYSLREERYSKIIVVDNASPDDCPECIVEEFPDVVLIKSEKNLGFGEGCNIGKDWVIVNTDCEYIFFLNPDTLVEPGLLQLLHDGFFSPEVGLVTPRITMMGDGLDILWYGGGYMNWLTGSARVPGCGLSAVSKIALEDRFVEFASGCAFMIRRSVLEECGGFDPRYFMYEEDVELSLRVISYGYKIYYMPKAVVRHLAQGSQGKEVEAVGMFKGRNPKLPFFVYQTAKNRFLTVFTHGTVLKKGLFLIGFMLWVFRNSFEWVRYKRLDAYNALFLGIKDFVKYTYVSGKK

SEQ ID NO: 18 - protein, 382 aa, Methylobacillus flagellatus
MKEINVAFVEPVGSHGGMDYYDSGLCAGLLHQGVSATWYTCDISKPCGNRPIFMQLTFVNIWGKDATWRRGARYILGLCRSIKHAKKNYSNIAHFHFFHVGVLEFLSVLFFRLFGFKVVATVHDVESFKPGLTFSILLKWTYFLCNQLIVHNQVSKDELINRSNVSINKIHVIPHGSYIGLVAPSMPKADARQALNVSSDEKVILFFGQIKEVKGLDLLIEALGLVKDKLKPFKLVIAGKVWKDNFSKYQELISKNGLNDFCKLDIRYIPDQEISMFYSAADLIVLPYRKIYQSGVLLMAMSYGTPVLASDLPGMAQIINDGENGFLFSAGNYIDLAEKLVKIFSYHDLSRITLQAENDMRTRFSWDEIAIKTISVYQKSIS

SEQ ID NO: 19 - protein, 501 aa, Methylobacillus flagellatus
MQLINSRRIVLLSLFSLMPLVGIAEVYKSTDVDGSTTYSDTPQANSQKIKVFPSDYKKNVKSEAAANKSRSNSISAANVTEAPIDESSSDSNVTIKHSTSNKSINSSNPSAAGGSSSAGGSSSAGGSSSAGGSSSAGGSSSAGGSSSAGGSSSAGGSSSAGGSSSETTTAASVDKVSAALQGPKAFLNSDDFKENSYRGFNVLGRKLSSADMEDLEKFNVNLIRSVIHLEKCKKCNDYEISPVELSQMDFLVEAGRKLGFYVIFAFDPKPAGDQAIYWNNQQLRESIKNNWVTIAKRYKNETVVAGFDLINEPVVRPGSVWEKYATELITAIRKVDENHIIFLEPSPWGLASSLEQFTPVPFNNIVYSFHFYSPQELTHQGLAAYPHAYIYPSEKWDKEYLNNRLDIARNWANKYNVPLYIGEFSIIRWAPSGSRLRYLTDVVERFEQEKWSWTYHSYREYSGWDAEMPDSIFKNDAIVERQNNVPVLQLLMKNFNKNKKY

SEQ ID NO: 20 - protein, 368 aa, Methylobacillus flagellatus
MHKKIAILGTRGIPAAHGGFETFAEHLAIYLERKGWKVTVYCQVDGNGPMYEDMWNGIKRVNIPISIQGSLGTILFDWKSTIHASNTYHLILTLGYNTALFCGLYRTKGITNLINMDGIEWHRKKWGAVAKLWFWINDWAGSILGNHLIADHPQIARHLETRVRPSKITMIPYGADKVIEANQAVLEEYGLKPFSYAILIARAEPENSILEVVKAWSAKPRGMRLVVLGKYNPDHAYQVAVKAAGSDEVLFPGAIYDKHVVESLRYFSRLYIHGHQVGGTNPSLVEALGAGNAVLAHDNRFNRWVAGDKAAYFSGEKDCEITLDELLNDEVRLREMRAGSLAQYDTLFTWDSVLQQYEALLTRFLPNK

SEQ ID NO: 21 - protein, 479 aa, Methylobacillus flagellatus
MQIQAVILSGGSGTRLWPLSRENYPKQLLTLLDNDSLLQSTLRRVDPLIGTECSPILVCNEEYRFVIAEQLRMMGRRGSILLEPVGKNTAPALTLAALEAASHGQDPILLVMPADHAIINVQDFQDTVRTGAEHAAAGKIVTFGIVPDRAETGYGYIKSGAVLEGFGSAFSIEQFVEKPDEATAQQYVVSGNYFWNSGLFMMRATVWLNAIAKTRPDILSSCKQAWDGQQRDGDFVRVDKLKFQQVPSDSIDYAVMEHVARGADNLPAGIVIPLNAGWSDVGAWDSFGKILPQDNAGNSHLGDVLFNDCSNTLAVSSGRLLACVGLQNIAVIETADAVLVIDKSKTQDVKKIVEQLKVQKRPEAKTHRKVHRPWGWYDSIDMGARFQVKRIVVNPGATLSLQMHHHRAEHWIVVTGTAKVTRGDEEFLVSENQSTYIPLGVTHMLANPGKLPLEMIEVQSGAYLGEDDIVRFNDQYGRS

SEQ ID NO: 22 - protein, 306 aa, Methylobacillus flagellatus
MATFNKILLTGINGQVGHALYPKLQSLGEVVALDRSQLDLSKPDHIRDVVRQTKPDLIINPAAYTAVDKAESEPELAYAINGTAPGILAEEAAKLNALLVHYSTDYVFDGTKTTPYTELDETNPLSVYGASKLAGEKAIQEVGANHLIFRTSWVYGAYGKNFMRTILRLAAERDSLNIVADQFGAPTSTESIADATITALHAWDGTQRGVYHLVNTGETSWHGFALEIIRQYGEIAQKKNLAKLKSTVENVVGITTAEYPTPAHRPANSKMSTEKFMSTFKTELAPWELALRSTVTHLATFSVENH

SEQ ID NO: 23 - protein, 182 aa, Methylobacillus flagellatus
MNVTPTHIPDVIVFEPKIFGDARGFFFESFNQKAFEEAVGRKYDFVQDNHSKSSKGVLRGLHYQIQQAQGKLVRVVAGEVFDVAVDIRKSSPTFGQWVGQHLSAENKKQMWVPPGFAHGFLVLSETAEFLYKTTDFYAPAHERCLSWNDPVVGIEWPDIGTPPLLSSKDQQGLGLHQTELFA

SEQ ID NO: 24 - protein, 292 aa, Methylobacillus flagellatus
MRKGIILAGGSGTRLYPVTQAVSKQLLPVYDKPMIYYPLSTLMLAGIRDILLISTPQDTPRFEQLLGDGSQWGLNIAYAVQPSPDGLAQAFIIGKKFIGNDPSALVLGDNIFYGHDLAHDLAHADQRQHGATVFAYPVHDPERYGVVEFNDAGQAISLEEKPKEPKSRYAVTGLYFYDNQVVDIAASLKPSPRGELEITDVNKIYLERRSLNVELMGRGHAWLDTGTHESLLEASLFIETIEKRQGLKVACPEEIAYRKGYIDAEQVEKIAQPYLKNGYGQYLIRMLKEKVF

SEQ ID NO: 25 - protein, 366 aa, Methylobacillus flagellatus
MTTLNNTIIVTGGAGFIGGNFVLDWVKAGLGTVINLDKLTYAGNLENLADIEGNPNHIFVHGDIGDRALVAKLLAEHKPRAVINFAAESHVDRSIHGPEDFIQTNVVGTFHLLEEVRAYWNSVVKTHPEEKENPQFRFLHVSTDEVYGTLGPKDQAFTETTPYAPNSPYSASKAASDHLVRAYHHTYGLPVLTTNCSNNYGPYHFPEKLIPLCLLNALAGKPLPIYGDGQQIRDWLFVKDHCSAIRRVLEAGQLGETYNVGGWNEKANLDVVQTLCSILDELSPKADGSSYKDQITFVKDRPGHDRRYAIDASKLERELGWKPAETFESGIRKTVEWYLQNQAWVHNVTSGEYRNWVSKQYSGSAA

SEQ ID NO: 26 - protein, 334 aa, Methylobacillus flagellatus
MLLVTGGTGYIGSHACVELINAGYEVVVLDNFSNSQAHIVDRIKQITGKAPVLVEGDVRDEALLSDLFSRYPFQAVMHFAGLKAVGESVAQPLRYYDNNVAGSVTLLRVMQAHDVKRLVFSSSATVYGDPASVPIREDFPLSATNPYGASKLMVEDILRDLAVSDPEWRIAILRYFNPVGAHESGLIGENPNGMPNNLMPYITQVAQGQRESLSVFGSDYPTVDGTGVRDYIHVVDLVVGHLRALERLDKEAGVFTCNLGTGQGYSVLEMVKAFEDASGQAVPYQLVARRPGDVAASYTDPAYAEQALGWKATRGIEQMCKDSWHWQQNLAQRG

SEQ ID NO: 27 - protein, 472 aa, Methylobacillus flagellatus
MLLPVIMSGGAGSRLWPVSRETLTKPFIELPDGRTLLQKTLQRTACLDGVSEVLTVTNKEYYFLTRDVYEATDTNVSHSYLLETIGRNTAPAIAVAALHAAAKHGEDVVLLVMPADHLIGNQKVFSKAVTVATDMAVNGWIVTFGVEPSTPETGYGYIEGGESIGDSGARRVVRFVEKPDLETAEKYIALGRFTWNAGIFCFTAKTIIAALAEYVPEVLEIAKKTLASSDSKTEPVVLGEEHFASSPDISIDYAVMERASKVAVVAADFDWSDIGSWSAMAELVQSDERGNRVNGEALLVDANNCYIQSDSRLVAGIGIDNLLVVDTPDALLVAHHSRAQDVKTVVKQLKLESHSAANYHRKVHRPWGTYTVLEEGANFKIKCIKVKPGASLSLQMHHHRSEHWVVVSGIAKVVNGERELLINANESTYIPAGHKHRLENPGLLDLVIIEVQSGEYLGEDDIVRFQDIYGRT

SEQ ID NO: 28 - protein, 264 aa, Methylobacillus flagellatus
MISMLKALWLYRGFVLGSVKREFQSKYRNSLLGAVWTVLNPLAMIVVYTVIFSQVMKARLPGVDSTFAFSIHLCAGILTWGLFAEIVGRSQTTFIDNANLLKKLSFPRLCLPVIVTATALVNFAIVFGLFTAFLLLIGMFSGWPYLVLIPVLILMIVFALGLGIILGVLNVFFRDVGQFFGIVLSFWFWLTPIVYPVSILPERVQDYMRLNPMARLMEAFQGILVQAKWPDWYSLWPVFALSIVLCLLGLSLFRKHAGDMVDEL

SEQ ID NO: 29 - protein, 178 aa, Methylobacillus flagellatus
MDSARSKFSYPARRDGGSFAVTAAKRSNTSIKPNLAVINWMLEQEDRMGLSTPRPYREFEERVYRHRDDLRRLIHSLVADGKKIYGYGASAKGNVVLQFCGFTSEEIPAIAEVNEEKFGRVTPGTHIPIISEKEARAAKPDYFLVLPWHFKDGILRREKDFLADGGRFIFPFPEIEIV

SEQ ID NO: 30 - protein, 346 aa, Methylobacillus flagellatus
MTIKTAIITGITGQDGAYLAELLLSKGYKVYGTFRRTSSVNFWRIEELGIENDPNLLLVEYDLTDLSASIRLLQSTGATEVYNLAAQSFVGVSFEQPITTAEITGVGALNLLEAIRLVNPNIRYYQASTSEMFGKVQAIPQTEDTPFYPRSPYGVAKLYAHWMTVNYRESYGIFGSSGILFNHESPLRGREFVTRKITDSVAKIKLGKLDCLELGNLDAKRDWGYAKDYVEGMWRILQADEPDTFVLATNRTETVRDFVSMAFKGAGIAVEFKGKGEDEVAVDTATGKIVVRVNPKFYRPAEVDLLIGSPAKAKAKLGWEPKTTLEQLCQMMVEADLRRNTEGFSF

SEQ ID NO: 31 - protein, 288 aa, Methylobacillus flagellatus
MRILLTGADGFTGRHFLTAAKAAGHEVVALRADLTDKAVLQREVEAARPEAVVHLAAISFVGHADVSAFYDVNVIGTLNLLDALAGLSVTPRSVLLASSANVYGNAAHSPITEEQAPAPVNHYAMSKLAMEHMARTYLDRLPLFFVRPFNYTGPGQAESFVIPKLVAHFACKAQTVELGNLDVEREFNDVAFVCEAYLRLLDKAVPGEVFNICSGAPVTLRAVIGMLRELTAHDIEVKVNPQFVRNNEIKTLCGDPSKLFRTIGEGRLVPLALTLKIMLEHATRKEKK

SEQ ID NO: 32 - protein, 380 aa, Methylobacillus flagellatus
MMKVGFGVTVLTRCLALGGIDGIGSYTRELMKRLEADPAVELFPISYGYSPSQFPIGSRAPTTFGRYAPLAAVSAVSGFPFLGTAQLKERVDLIHAPDHLIPNYGKVPVIASIMDAIPLSHPEWVSPKLRKMKNALWKRSAHWASHIITISEYSKQEISQHFGIEAQKISAIPLGVDERWFQPLEEEAMKVVLRRYNLPQYYFLVVGTLQPRKNVGRVIEAYRSLPQGIRNEVPLVIVGRAGWRCEDVVEMLTSSSSGNSLRWLKHLPDADLLAVLKGATALVFPSLYEGFGLPVVEAFAAGTPVITSNTTSLPEVAGDAAMLVNPLNVSDIAAAMQSMLEQPELAESFRNKGQERALAYSWDKTASMTLDVYKKTREAA

SEQ ID NO: 33 - protein, 399 aa, Methylobacillus flagellatus
MIIRFLGAQWLAVGFVGVISLAVSILIARTLGPDSFGVYSVVLSGGAIAAILLDGGFGRLLQRERAHPTPALLRFLPILPQAALGHVIIAASIFSLIALLVLPKHALTIVAVIWFFAASVTNQFGLNILRGDGRMVRDASWQMGNRTFTAACVCIVILMGAEKPWQVFFAQFVGATAFGLLIMHYLRTRPLWKIPPTLYAATLPFVWLDLATVLYFRADMLLLEWLDVSKFEVGKYGVACRLIEAVILLASPLCIILFRKFRLGSASPRLMLRRMLPVLAGALMVGVFFMVFFWLCSTPLIAVAYGEAYAGADHILAILGCALLFILPNGVLNQAALALGIERWLAMSASFAAVLNIAGNLWLIPQYGLIGAAWMTVVTEAVLGCCVALGLWRHRNRSV

SEQ ID NO: 34 - protein, 377 aa, Methylobacillus flagellatus
MQDLAVAHVYRTYFPDPPGGLQEAIRQIALTTGMQGVDNTVFTLSPQPRPAILQRPEACVVRCRSWAAPASCDLGGIGAFLAFSRLAEKSDVLHYLFPWPFADVLHTVVRPGCPAVMTYISDVVRQQLLGRLYAPLMWKVLRQMRLVVANSPAYARTSPVLSHPEIREKVRVIPLGIEESSYPKSGDEEILQRLGIGKDEPYFLFIGVLRYYKGAHFLVKAAKRIGAKVVFAGAGPEGARLKALAGEVGAENVIFAGMVTNAEKVTLLQCCRALVLPSHLRSEAYGMVLVEAAMFGKPLISCEIGTGTSYVNHHEETGFVVEPASPEALASAMAVLLSEDRLATEMGAAARQRYELLFSGPALGKAYAALFREVDAS

SEQ ID NO: 35 - protein, 313 aa, Methylobacillus flagellatus
MMQLLVTGATGFVGKTLCSALRRQSFPVKAIGRAGTIRADALGDQVASIDGQTDWSLILDGINAVIHLAARVHVMREQLADPLAAYRETNVEGTLNLARQAAKAGVKRFVFISSIKVNGEQTLPGKPFTAYDVPAPEDAYGISKFEAEQGLLALARETGMDVVVIRPPLVYGPGVKGNFASMMKLVKSGIPLPLGAIHNQRSLVAIDNLVNLIVTCIDHPAAANQVFLVSDGEDLSTSDLLRRLAKAAGVSSRLMPVSARWLEMGLRMCGKRLIAQRLLGSLQVDISKTRELLGWVPPISVDEGLKRCFSTKG

SEQ ID NO: 36 - protein, 183 aa, Methylobacillus flagellatus
MIRFFDIIFSVIGLVLGFPLLLSIYTLGLFDTGAPLFRQVRVGRYRQPFTLVKFRTMKVDTASVASHLASTNSITRLGRFLRRTKLDELPQLWNVLKGEMSLVGPRPNLFNQEELMAERELRGVYHARPGITGLAQVNDIDMSTPRLLAETDARMLREMNVRLYFKLLIQTVLGRGQGDRVVR

SEQ ID NO: 37 - protein, 637 aa, Methylobacillus flagellatus
MLHYFPSFKWSNYISLKNPRSLSAWIYDIVAAALAWWAAFLLRFNFDIPANFVQSMLDSAAWVIPLQAFVFLLAGLYKGVWRFASLPDLQRLVRAIAISAVLVVAILFMFKPHGIVPRSVLILDPMLLLLLMGGSRFAYRAWKEHRLYGSAQFSGKPVLVLGAGEAAIALLKDLSKSREWHVVGLLDDKKTMHGRELLGVNVLGSIAQLPQIAADLSVNHVIVAMPSARHQRRREIVELASRNGLTALTVPSFDDLMSGHLSMAQIRPVEVEDLLGREPVSLDGEGLQHLIEGQVLLITGAGGSIGSELCRQVLKYRPACLVCLDQSEYALYRLEQEFDNLEFDTRIEYVVGDVRNARRVGQVLGRYMPKLVFHAAAYKHVPLMENRNVAESLSNNVSGTYTLAQACKTAGVAKFVLISTDKAVNPTNVMGASKRLAEMICQGLQEESGTRFIVVRFGNVLGSSGSVIPKFREQIAAGGPITVTHPEITRYFMSIPEACQLVMQAGLMGGGGEIFVLDMGDPVRIVDLARDMIRLSGLNEDDIQIVYSGLRPGEKLYEELLADDELTVPTPHDKLRIAVARSVDGAWVQALLKWIDRASLIDESVIKQELGMWVEEYAGDIHANPSMMFPPESSTIH

SEQ ID NO: 38 - protein, 291 aa, Methylobacillus flagellatus
MAKKITKAVFPVAGLGTRFLPATKASPKEMLPIVDKPLIQYAAEEAVAAGATELIFIIGRNKRTIPDHFDKSFELEATLEASKKTKVLEEIRNILPKNVSCIYIRQAEALGLGHAVLLAKSVVGSEPFSVILADDLIDADKPAMQQMTELFDQEGVSILGVEDVEPSETASYGIVDATEVSGPNVLQLNGIVEKPQPEEAPSNLAVVGRYILTPEIFECLENVKPGKGGEIQLTDGIAALMEKQKILAYRFDGKRYDCGSKLGYVKANVEYSLKHEEFGKEFAQYLRDLTK

SEQ ID NO: 39 - protein, 272 aa, Methylobacillus glycogenes
MLQQFSIGVREHHHKELTPDQAGAFLEVVDASLRIKKKAQFFSWLQGYFQFLLPHEVLLCGLSIGAGRPFTLETFSSTRYVTDTHTAVSMQETDGVVLRAIQSWQETSLPVLVDPYLRPGSFGNFTVPEIDQANLQASELRNLAAYGLSSADGSISSFFCFSRVAGELNGNHAYLLELLVPYLHSVLMRVSDSATASADMLGDSSVAGLITMREKEILHWVHTGKSNWEIATILQISPLTVKNHMQNILRKLDVQNRSHAASKAFRLGLIRN

SEQ ID NO: 40 - protein, 379 aa, Methylobacillus glycogenes
MGYSDPVLAREGDVIRPYVSATYVYDDNLRRRSDKESDTSVVGRVGIILDKDISQQNFYANIGVNETKYNKNSELDNTGKDIVARWNWAVGSQFRGKVEYYKNEAMLPFADFRGVELNMRIQERKTFEANWRFHSSWRARFGVQRQDVEYDSQTLNAASFQENSQHVGLDYLAESGSKVGLVFTNGRGTRPFDRPAFFPGIGTVFVNNDYRQQSLKADILWLYSAKTRFEFLGGYVDRKHDSFSQRDFSGFNAHGNMVWSITDKTSFKTAAWRDANAISIVTASYVIDSGASASISYSATSKILLSTSARYQQLKFEGDITGQDQGRTDKNKVFSFGVTYSPLESLSFTTGLNRSLRDSTSPILNYNSTSISLTGRYEF

SEQ ID NO: 41 - protein, 449 aa, Methylobacillus glycogenes
MTVNDIPLVAFFKQLLDPLIILGTLYVFTLLFGEPFNGYYLILALLAYFVSSNVYERLDLYRTWRSGKILGYIRDILFGWGIVIAVLMFIGYAADLSSQYLDEMIYAWFASVPMIFIVTHLAIRKIASDLHKNGEVRSVVIIGANDIGVRLINRITDDPYLFMEVKGIFDDREVARHPKGMRNLPLLGSMSEIAPYVRANNTQIIFISLPMSAQPRIRQLFEELQDTTASIYFVPDIYIFDLVQARFDDVAGVPVVAILETPFTGFNSLIKRTSDIILASLILLMLSPIMLTLALAVKLTSPGPVIFKQRRYAEWGNHCLIPLHESNGRWQGSTGAEARSAIDTDWWFLAQELTGAAAVHQCVARSDEYRGATACRFSAISQADSWLYAAAQGQAWNNRLGAGEWFTWNYLGQDGVPYRVLGLFAPLVPGFLLDYRQDGAGCVQKRRLL

SEQ ID NO: 42 - protein, 310 aa, Methylobacillus glycogenes
MNNGFVTNFKQSRTLCVGAVIVLAFALSGCGDKHESKASQSLVKVNGKEITVHQLNQELGRANIQENQREQATQQILTALIDRQLLEEAALKAKVDRDPNVMTTIERAKSQIIAQAYLQSKLGSVAKPSKTEIENFYNENPQFFSKRRMVEMDQLLIDTKFANDELKTALGKLKTLQEVAAWMDAHNIQYDQGQVSRSVAELPPQISERLKAEDKGKLFVIGMGPRTMLIMMNEIKDSPVSLAEATPQIENNLLNKARKEVAENEVKRLKADAKIEYIDKKMETATETKAAKKKPSSTEDDIASGVSGLK

SEQ ID NO: 43 - protein, 264 aa, Methylobacillus glycogenes
MKKLMTWFFLLMLSLTPFVTHAAEGDILLGAGDVLKISVFEQPDLSLEVRVSESGSITYPLIGEVRVGGGTVAAAEQRIATMLEKGGFLKSAHVNIIVAQLQSLQVSILGQVNRPGRYPIDSAKTLADVLALAGGVSPEGGDLITLVHNVDGKAVRDQIDLADMMRTGDLSKNIRVAGGDIIYVERFDKFYIYGQVQRASHYRLEHEMTVLQALSVGGGLSPRGTEKGVKIKRRDASGHIEVITAKHDDLIKPNDVIYVQESFF

SEQ ID NO: 44 - protein, 462 aa, Methylobacillus glycogenes
MSFSQLLLIFKARYKILLSTIVVALVVAIALNIFLPNSYKATTSILVNYKGVDPVTGMAVPAQLLPGYMGTQVDIITSKKIAKRVVTTLKLNESSEVVESFNDSTGGEGDIVDWLADLLISRIEVQPARNSSVLQLEFDGANPKFAAVVANSFAEEYIKATIELKVEPSKKAAEFYTGQLKDLRADITRAQQKLSDYQQDKSIVSVDERLDIERAKLNELSSQLVMSQGQTLEAQSRQTGAQGSNAYGSPDVASNPMVLHLKTEIARSESRFADISQKYERNHPLYQGAKAELDNLKSELSKQIQAATVNISSNYRILKQRESEIRNALAEQKTKVMLLNKDRDALTVLTREVEGAQRAYELATQRYTQINLEGQSNQADVSILNPATPPLKPSSPKKILNVAVALVLGTIFGLLFSLLAELTNERIRSERVLVEIVGAPLLGVIDKNKTHSRIQRLLAKKP

SEQ ID NO: 45 - protein, 292 aa, Methylobacillus glycogenes
MTNDVSNTSSIPALNADFNIGGMLLKMGKITPQDAERILRVQKERGVRFGEAAESLGLVSSADINYVLSKQFAYPYLMDGRGDFSENLVAAYDPFSINVEKYRAIRSQLMLYWFAQGKKSLSFSSVYDKDDTSDLVANLGVVFSQLGEKTLIIDAHLDSPRQNRIFNIKSTAGLSDILAGRVTDYSSSITRLVEFEHLSILSSGTIPPNPRELLGRGFLKQFITAIANDYDVILVDAPSFVRHSEPLSVASATEGVVLLAKRHVSKANDLSKVVDQLSKIRVPVVGTVLTEN

SEQ ID NO: 46 - protein, 299 aa, Methylobacillus glycogenes
MSLNQSIAVASTQLRRYQHVIPLLVGLLFLFVPTYLNLTNTVWQMQDQAHGPLILMVVLYLVWVDKEILLDTANLRQSGRGVGLLLFLFGLLVYIIGRSQDLLVFDVGSQIPVLAGLLLIFYKAKTLKRFWFPLFFLFFMIPLPGSMLDVVTLPMKVAVSYVAEHVLYWFDYPIARSGVIIQIGQYQLLVADACAGMHTLISLEALGLLYLNIVRHDSLARNLLLALLIIPISFSANVIRVIVLTLITYYFGDEVGQGFVHGFAGILLFVVALTLIISVDSLIQYFVGKHTQRKARLQS

SEQ ID NO: 47 - protein, 228 aa, Methylobacillus glycogenes
MSVRLINILAVCMVVSSGLALALTPDLSSVRDDPHLESFVPSSFGQWQEVKTNQVQMDLTVRRDGEPSIDNPYDEVLMRSYANEKGQVIMLALAYGKLQRQEVKVHRPELCYTAQGFSIRNQQDTAVNVGAGATPIPSKALVAASRQREELVLYWIRIGDMISKSAWETRLYIVEQGLKHQLVDGILVRTSQILGEDDAEQSLQLQQQFLHDLVQAVPRDKRKYLIPS

SEQ ID NO: 48 - protein, 378 aa, Methylobacillus glycogenes
MKILFLSHTAAGGEFVVGSHQLSKQFALQGHEVVHLSPPVTPAHLTLLQKTPFERVRFKRWMKAGDVINHVTDIIPFSLIPWGIATRLGSGSDIFGYFLKFSALRQLRKHQFSNPDVVLIDEPRLGYLLKYFPKSKIVYRPTDIYHEIRNDPSIVDAEKGLISQVHGFIATSEPVRQHLNRLGVDEVLLLQNGVDLDHYLNFTKSKLDLPPEPRAIYAGALDHRFGFDVLKSAATKHQKISFLLAGPVEEKYKAAFSDLANVHFLGHVQYKALPNLLSQCQIGLLPMSDHPSNLGRSPMKLFEYAAVGLPVVSTSTPELERRSLPFVFLAENAQIFTDKLGDVCNADIKILAQQARDNAKHESWASKTITILNYIYSK

SEQ ID NO: 49 - protein, 420 aa, Methylobacillus glycogenes
MNKTTEPQDSQTNVPWWLSPHGLCLGFLLPMILLIWWLGSVRSPTLTIRGYIYLSSEYIALAVLIVVLSASAAWMGSFVKTKVRVPPDSQVNMALRVLGYVAVAAYIYWFKELIINPMNIINIFTGTGLSRQEIGATQGITSLVNFTPIFISIYIYARYIAKLPLRQDVVLLFYAIVLLTLLRVFAWAERLALIEIILPFALLITRQQVFSKIKILQFFIKAGPFAGLPLLVLYFGMAEYFRSWSSTTYAGKSSFWDFALGRIASYYYTSLNNGAGMLATVNWPTYEFENVLNWMHKFPIFGGVFRYYVDLHTMRMGEFLAQYGDEEFNNPSGIFSVILDLGLPFGIIYFFITAFLAGIFYKGYLRGNFLSVIFYPLFFITLLEIFRYPYLGTSRAFTEIIGVIIAFFIVKGRTENDRKS

SEQ ID NO: 50 - protein, 454 aa, Methylobacillus glycogenes
MIENRRHLVKSLFLMLFSSWLPKVASAAPKVVGGNADFTRALDDALAGRTEVLSGYYEISNPLRFSLKSGTVKFAPDFQLKFLNDKLSGLVFSSCSDLSLIGGDFSYKNPPARRIGHGGIYEFSRCTKVIVRDGFYYDTPGTGIIFTLCDDCAVIKATVWNSWADGLHFANCNNCIALDYQSTNTGDDGLAFVNYKKHPDAVGGYANNIVINGSYARGIAIIGQSGVTIDKFEIRHTSAEGLKIGSEQYYDTRIPSNVTIKNGIVEEAGTWCVAKATGNGFLVQGATDKIVVENLTVNAPRVHGIVFDRHGGNVKMKDIVVKNTKASGITMMADNIELVNGEFLNIGTTPLYVNKALTANFSKINVNTFGFADKSSWPIFWAVEAKNVLINQMKVESTTLVRIGGKNVISHQITGVQISGVQLSGLLSDGLNSKTTSAVSAITSTAVKFIEQWN

SEQ ID NO: 51 - protein, 368 aa, Methylobacillus glycogenes
MDAGARLRISWIDVCRGFAMLLVVVGHNQILMGQSLSLVKFIYLFHMPLFFFISGITLKPDQGLTYYFTRAINVIAVYFVFSFLVLPFVLMKNPDDGVFNIVLGILYGTGHTIEVAPLWFIPCLFFSIVLVGLALVISNHFNNTDRESNRSPIFFLALLFIGVGVFLINSIHYYLIDNLAWGSLKNSGMIWSIDIAIIGAGFILLGMYAKVFVDKYKITEIKSIYLIVSIVCAIFVMLGLFSFGVDVDLNFRKIAHYPLAMLCMILGIFFSILFSIFLDKYTYLSTILSSIGKSTLLILLFHNAIQNHLIFTIGDSKIYSAVIGIVIAILIPIVLDKFVVNKYELFRKIVYPKLSINLASKIMVGKRF

SEQ ID NO: 52 - protein, 365 aa, Methylobacillus glycogenes
MIVYINGRFLGRRITGVDRYAIEVLKELNTLIAENHPSVAGVEYKIVIPPRIKTDLHLTHIPIVAYGFFSGHAWEQLSLLMLSLSSKSMVLNLCNTGSIFVRSQIVVIHDAAVVRIPSTFSLAFRVWYKTLMPVLGRVAKKIVTVSEYSKKDIINFFGVHPEKVQVVGAGGEHILSQQPDAGILEKFQVHPGSYVLAVSSHAPHKNFSLTIESLKLSKNANIPYLIAGGANQKIFGENSQLDSSKVTLLGYVSDNELRALYEHALCFVFPSLYEGFGLPPLEAMNCGCPVLASNAASIPEVCSDAALYFSPHDPQELSKLIDNVAHDADLRKSLVNQGLKRAKDFSWKNSAIDIARMCKEIFTIK

SEQ ID NO: 53 - protein, 384 aa, Methylobacillus glycogenes
MTNKYTRHSRLHPKKVAIVVDWLNEYAGAERVLEQLVLCYPDADIFAVIEFLPDNLRGFIQNKKVTTTFIQNLPKAKTHYRNYLPLMPLAIEQLDLSQYDLIISSSHAVAKGVLTGPDQVHVSYVHSPMRYAWDLQHQYLRESNLVSGFKSWIVKWLLHKLRIWDLRTANGVDVFIANSSFIAKRIKKVYGREARVIYPPVDTNSFAFQEKKDDFFLTASRLVPYKRVDLIVEAFSKIPDQKLVVIGDGPDMSKVRAKAGPNVEILGYQSHAVLRDYMQRAKGFVFAAEEDFGISPVEAQACGTPVIAFAKGGALETVIPEERGDPATGLFFHEQTADAIVDAITRFNLLSQKISPFACRENALRFSPDRFRNEIISTVNKALD

SEQ ID NO: 54 - protein, 388 aa, Methylobacillus glycogenes
MKIAVAGTGYVGLSIAVLLAQKNEVVALDIVPDKVDLINNKISPIVDKEIEHYLKNIPLNLRATTNKHDAYENADFVVIATPTDYDPVTSYFNTSSVEAVIKDVQAIAPNATMVIKSTIPVGYTKMISEKLGVDNLIFSPEFLREGKALYDNLYPSRIVIGEISDRAQVFADLLNAGAVKENIPVLLTNSAEAEAIKLFANTFLAMRVAYFNELDTYAATHGLNTRQIIDGVCLDPRVGDHYNNPSFGYGGYCLPKDTKQLLANYDNVPQKLINAIVDANTTRKDFIAQSIIKRDPKVVGIYRLIMKAGSDNFRASSIQGVMKRIKARGIKVVVFEPELKEDQFFNSEVIRNLEEFKKISDVIVANRRAQDLSDVDEKVYTRDLFGND

SEQ ID NO: 55 - protein, 323 aa, Methylobacillus glycogenes
MRILFSPATASNQYVENTIALIKTLDATHVETQARLNAGFILRNAFNRYDCIIINWLENNLVGKNKSLDIWAVAKFLFKFFIYRVMGRKLIFVRHNIYPHALKGRQASIATWIIEAAIKLSTISVVHSGHLENENAKYVPHPLYRVDSQVEGQGSDYYVIFGRIVAYKAIHKLLESWGSQRLIIAGIVEDHAYAASLQSIIQSRGLSNVELRAEFLSEAEAEQLVANSKGLILSHCDADMIVSGSFFFAASLGVPVFAMDTPFFQWLKNEQGYQGLQVFTSLQAMTAELATAAAVEKNTIAASAQRLFGNDRVRSAWGSVLHG

SEQ ID NO: 56 - protein, 470 aa, Methylobacillus glycogenes
MTTIGQDVNQPAGIPEVFTINDVVDRGLCVGCGACAVVDSNVKLTRNQYGSMVAAIDANILPGSIADRVCPFSDNSLNEDVVGERVFASCENFDQRTGYYTNLYYGRRFTEAELLKSSSGGLTSYVAIELLKRHHVDGIIHVGRDQSDDRDALFKFMVSYTEEDANACKKSQYYSLSFDEVVRSIRGDGKRYVFVGVPCFVKSLRNICLNDAVLNEQIPFMLGLVCGHLKSSRFAELLAWQLSVPPEKIQSVDFRVKNNASTVNSYDFQVVDSNQQAHAKTSNTMLGGNWGHAAFQLQACDYCDDIFAETADAVFGDAWLPQFSTWWQGTNIVLVRNPIIDDILESGKNAGAITLGGVSIDDLCKSQLGNFRHRKDGLIVRLDDDLKQGKKVPKKRVDLSALGKIDQKRKKIVRLRKEMAVKSHEYFLQAREKHDLSLYMKPMGQLARNMLKLYRDPFMKRLINRLKRYF

SEQ ID NO: 57 - protein, 482 aa, Methylobacillus glycogenes
MSLSVKAARGGVVMMSGQIVKVALQFGSLIILARLLQPEDFGLVAMVIAIYGICDILLDFGLSTASIQVQNITKAQISNLFWVNVLIGLLFTLISYFSASLLASFYAQPELTKIAQYVSVVFLFNGIAAQYKAQLNRNFKFKQMAITDTTAVLLSVCIGVYFAYAGHSYWAIVYQQIAQALIQMLLYMLFGAWLPSLPSRHVSIRHFFKFGWGLAGSQLMGYFSRNIPAILIGNQIGASQLGFYDRANKLLMLPLNQLNAPSSSVAVPVLSRLAVEDQEKYNRFLLFGQNIIVHLVVFCLALTCCQTERLVQLVLGTQWLEMVPVYRALSFAGIFLALSYASYWVFLSKGITASLFKLGLVSRPISILIICLGLPAGVIGVAYAYSASLLFTWLLGVFWLRKTGVPVKSMIVDPLIMSAIYYSASFIANYVVDHYVDFAIYNILVGWLLMLLILAVFYLLVPKFKRSVKKLFEVKSYIRNKQ

SEQ ID NO: 58 - protein, 401 aa, Methylobacillus glycogenes
MKTIKKLLYKILGSAGIKAKAAAVINLLFGRVARSTNDSVSILIPAPGGGNIGDQAMLESFLHNIDGKKLIIKTQPIALDIPSHYAVNVEVIEMPGLIYGHLFRFLRDYVRLRKIMASASALYVVGADIMDGGYNKNASIMRSKIATYFARNNIPSRVFGFSWNGNPDAAALSAIRNAAANGVLLCARDPLSFQRLQDAGVPNIRLVADMVFANDNTKSAGIEDILQFCAGKQIALVNASGLIGKNIDQIDEYSKVINKLMDHNFNIVLLPHVIRHGANDLPICQALSGKYPNAFLVNRLLEPDQVKRLAQEAKIVVTGRMHLSIMSLNQNVPSIVLSTQGKVDGLMQFFETEKLSINPEKGFSDLICSQIDFICSNRQYYQDLIRKNLLKVKELAAGNFN

SEQ ID NO: 59 - protein, 395 aa, Methylobacillus glycogenes
MSKFYKFQVLESLRGYMAWWVVLGHAIQLSGFWHKQEVDEFFTGGGIINATFSKILSLIINPELAVNIFIILSGFVITHLLLTKNEPYSHFITRRFFRLAPAFYVSLVIAILVVNFYKVAYTGLSFSGDTSMRLARLVEQDSNFLLHLFNHLLLIHSVFPQELIQFSPTTFLAPAWSISLEWQFYLIAPVLIPFLVKSEKSLIVWVVLLLLLRYFTNHVLDFNWQHSSFFFKAVDYFLVGILSRLIIERLQHGKFIYDVAVLLGGILLFQDRYCAVIWLFVLAVIFYEMGYWSVKSPLWKKILTLFFYNKVITNIGKWSYSTYLIHIPIFSIFLGGYATLTDPGTVTQQISLIILFVSFPVVLLISNIMYHNIELPSMNYISAKLKEKRITESAE

SEQ ID NO: 60 - protein, 468 aa, Methylobacillus glycogenes
MKIVPVLLSGGSGTRLWPLSRAVLPKQLLPLITNKTMLQETLLRISRWATVTNPVVVCGNDHRFLVAEQLREIALSPNSIILEPAPKNTAPAIAAAALQLQGQDVYMLVLPADHVIRDLQSFEHAVQTALTAADQGNLVTFGIKPAHPETGYGYIKLGVESAPGSYKVNRFVEKPDLATATEYVASGEFFWNSGMFLFKPETFLKQLEIHAPEITAAVSKAVNNSYKDLDFVRLEESSFAESPSLSIDYAVMEKTDHAVVVPADIGWSDVGSWTSLQEVQEQDANGNVARGDVYLKNVENSLVRSEDRFVAAIGVRDLIVVETSDAVLVASKDAAQDVKEVVEYLKLNQRSEHKIHPRAYRPWGWYESIDLGERHQVKRIMVKPGEKLSLQMHHHRAEHWVVVSGSAMITVDGNTKLFSENQSTYIPIGSTHRLENPGKLPLHLIEVQSGSYLGEDDIVRYEDTYGRS

SEQ ID NO: 61 - protein, 110 aa, Methylobacillus glycogenes
MLTDEYRYKILKLVQEKPDISQRELAKALGISLGKTNFCLKALAQVGLLKVSNFRNSKNKLAYMYVLTPTGIEHKAAVTLNFLKLKLKEYEQLAGEIEELRSEINAKVND

SEQ ID NO: 62 - protein, 362 aa, Methylobacillus glycogenes
MLKKVALITGITGQDGAYLAEFLLGKGYVVHGIKRRASLFNTDRIDHLYQDPHVDNQNFILHYGDLTDSTNLIRIIQQVQPDEIYNLAAMSHVAVSFESPEYTANADGLGTLRILEAIRILGLEKKTRFYQASTSELYGLVQETPQKESTPFYPRSPYAVAKLYAYWITVNYREAYGIYACNGILFNHESPLRGETFVTRKITRALARIKLGLQDCLYLGNLDALRDWGHAKDYVEMQWLMLQQEQAEDFVIATGVQYSVRDFVNAAAHELDIAITWKGQGQEEMGYDGQGRCIVQVDPRYFRPTEVETLLGDPSKAKQKLGWSPSISFQELVSEMVREDLKSAERDELVKQHGFAAYDYNE

SEQ ID NO: 63 - protein, 313 aa, Methylobacillus glycogenes
MDKHARIYVAGHRGLVGSAIVRGLEGKGYSNLIKRTHAELDLTDANATEAFFAQYQPNMFSWRQPKWVAWPITLTRQILSVTISQFRTVSIVPGSMESAYCFGPAAYTPSMLLSPCMSTTFPDRLKLPIVHTRWQRLLESKCAGVITGSMALDFLQQCRQIFMGLAITITCRIVTLSLHYANSTRLNKLGMQLYRSGVLEHPGANFFTVRIWQMPVYSCICLRRNSILCWEVMRVLLVCLIHHSISVLESIFQYRNWPNWKRWLVTKEQLSSIVQNLMARCVSLWMASSTVWGGLIPLSLMMDWKRHIRNFQN

SEQ ID NO: 64 - protein, 231 aa, Methylobacillus glycogenes
MKKKVFALIPARAGSKGVPKKNLKNIAGSPLIAYTINAAKKAKNVDAVYVSSDCKEILEYSKAQGCSSILRPQEYATDDASAVDVVKHFISIENIEDGDLIVYLQPTSPLRDEHHIDDALTALNNNGLTSLVSVEVLDKSPYKSFRLDDNDKLISLFDEKLSNYRRQDLPLCYAPNGAIYIFSKFEFEARGGFPSNGSVAYIMSAEESVDIDTEEDFLETEALLRKKYGIF

SEQ ID NO: 65 - protein, 346 aa, Methylobacillus glycogenes
MASFEISGRKIGDGHEPIVIAEIGINHEGSLDLAIDMAKAAIDAGAEIIKHQTHVVEDEMSDEAKSVIPGNADVSIYEIMQRCSLSEDDEYKLMQYVQQQGSIFISTPFSRMAANRLRKFDIPAYKIGSGECNNYPLVRHIASFGKPIIVSTGMNSIESIAPTVNILRQAKVPFALLHCTNIYPTPPELVRLDAIQVIKNAYPDAVVGLSDHTLGNYACLGAVALGASILERHFTDSMSRPGPDIVCSMDPAALQDLITGSKVIFSAKGAHKGPLLEEEKTIAFAFASVVAIKDINVGDVLSEDNIWLRRPGGGDFNASDYDQLLGRKASQTILSGKRVNRQDIEA

SEQ ID NO: 66 - protein, 363 aa, Methylobacillus glycogenes
MSRRVVFLTGTRADFGKLKSLMRALQNDMGFDVHVFITGMHMLSKYGYTCEEVEKAGFKNLFRFINQNQSDSMDHILAKTITGLSDYVKEISPELIVIHGDRVEALAGAAVGALNNIRVAHIEGGEVSGTVDELIRHAVTKLSHGHFVSNEQAKNRLIQLGESEESIFVIGSPDIDVMNSTSLPSIDDVRERYGFSFEHYGILMYHPVTSELDDLPRQAKAIVDYISESSLPFIVVYPNNDHGSDIILNEYLRLKNLSHVRVYPSIRFEYFLTLLKKCSVHHGLRWSKRGSSFRRASHQCWQATQSNSRVDSYYCTCGFPTCCSTSCRHSSRGSFLWWCRVSSDSVECFLGGHTKALYRECSV

SEQ ID NO: 67 - protein, 245 aa, Methylobacillus glycogenes
MRLIARLDVKNEHVIKGIHLEGLRKVGDPIEMAKNYYAQGIDEIVFIDAVASLYNRNNLLSVIAKASEEVFVPITVGGGLRSLADVEMALSAGADKVAVNTAAILNPKFITEIAKRYGSQCVVASIQAKRIGNDWEAYMEAGREPTGKNVVAWSKELEDLGAGEILLTSIDQDGTKKGFDLPLLGAVNTIVNIPVMVSGGCGNPDHVQELKEIQPSGVCLASVLHYKINTIDEFKQRLTFINGTK

SEQ ID NO: 68 - protein, 212 aa, Methylobacillus glycogenes
MKKICILDYGLGNVRSVSNAIKYVGAHPVISNTPEALKDSHALIVPGVGAFAQGMSALGKDGLQASLLEYIKSGKHVLGICLGMQLLFDRGEEFGVTTGLGLVPGVVSRIVPVEQSRVRLPHISWAKVDLNSVHENNGGMFDGLPDEQRKFYFLHSYAAQNVPDRYITGSATYSGCTFVASVQKDNIWGMQFHPEKSGPSGLQVLNNFVQNS

SEQ ID NO: 69 - protein, 408 aa, Methylobacillus glycogenes
MKRSVEEVVVNAYFGLPEDVVFCKKCVISNQRPSSTVEFKHTNKDKKATIGFGADGICDACRYAETKDAQIDWQAREDALVRLLDQHRRSDGGYDIVVPGSGGKDSAYTSHILKYKYGMNPLTVTWAPHKYTEIGWKNFENWIHKGGLDNILFTPNGKLHRYLTKMAFLNLLHPFQPFIVGQRIIGPLMAKKFGIKLVMYGENQAEYGNKTEENYKPTMDKNFFSISDPADMVLGGVKVGDIIKDGEYSLNDFAPYIPPAAEDLERDGIEVHYLGYYLKWDPQECYYYAVEHTGFQANTERTEGTYSKYSSIDDRIDMFHYFTTLIKFGIGRATYDAAQEIRNDKITREEGVALVHKYDQEFPKKYFAEFLEYIEITEAQFWETVDRFRSPHLWEKQDSNWILKHQVT

SEQ ID NO: 70 - protein, 397 aa, Methylobacillus glycogenes
MDTEASGDLRMKVLQIGSFSGNVGDIANHYGFRNWFQGLLGEIQWDEFEIRNVYRKNVAFDDNFVAIANQYDLIVVGGGNFFELWVDSSPTGTSISIEIEVFKKIKVPIFFNALGVDDGMGCSDESLAKFTNFLEILTSSKQYLVSVRNDGAMGTLRNRISNNPMLDKVLPLPDGGFFVNLDKLEKDIAENDHENTQITIGINLAGDMLETRFPGGINGYDYSGFISEFTETLAEMWNKNKLIKFIFFPHIYSDLKVYADILSRLPDACRRENVKVASYDTNVNFQGTLFSEYSKCTLILGMRFHANVVAIANKIPVIGLYSYKQIKELFYELGIKEKIVDVRQIGFKNELLRKCNIVIENSSISRDESCNILDVVTKKRDLIAPRVVEWLREHKLK

SEQ ID NO: 71 - protein, 355 aa, Methylobacillus glycogenes
MIKSLDYLRAIAALTVFLSHTFQIYWLPTIGLVSWKYELNHFLSETAVLLFFVLSGYVISNSLHSNTQRNGGRLSVLDYASSRLLRIYPPLIVSIIISLVAYSVIVIFELPGSVGTLKAPGDIYQARDYLSIGTRDIVNSLLMNNGLLQMNGPLWSLCIEAKLYFYACLVVIIFIHYKQKNLLNFIANTGFLVLSVFLFFNTKTDIYYGLWWLSGGVIFLYRRNFIKFMTLVVVMAIVVFAMAVIGQKFVSLPVQVIFVYSLFLAAIKCKVPEIKAMNILANTSYTLYIVHFPMLLLSYAIFSYNFDVYGSLTRELMSSLSLIIILTMSIYIGKWVERPANLRLTYHRLLRKVKV

SEQ ID NO: 72 - protein, 559 aa, Methylobacillus glycogenes
MKAMFYSLHAAIWLHALPESRLASQLSNAGHELVYVTCDKSFTHYCTGMSAFNLALNEDFKKKSAICELCINNANKITKSFDCKHLKLHDYIDQKTNALIDNLLKSVTEDNFLEFHYEDIPVGRLATYEPLLKYKKMSLEFRDEQWQDLQIHLRNALVSLIGFIQIFKQECPEKIFFYSPQYGVNGVCAEYAVKQGRQAYFIEGSSSNAERYSALRVWEWSKFKLVNPALQHWQAVKNLVTLEDIDRVSAHIHELFKGKSFAVFSAPKTGNFSIREKFNIPQNAKILLASLSSFDEAYAAFVIKGFPERKVKSPVFSDQFEWIKCTINFMKSRPDDYLVIRVHPRDYPNKRDSNQSEQALIWEKILQDLPENVKLNSPDQNISLYDFLDDVHALVTGWSATGVEALLHGIPVITYDKYLPSYPADIHLTGESEHEYYDNLIKVLSLATSTDNTHVVNAYRWLAVSFSLGTVRVNQPLEIGLSWPDKPAYRILKRVANKFSVNLRKSYDVWNVQSNDTDRLRFLSLVLNNQSSLFEGVISDVVDAVSDYEIEATVKQHSI

SEQ ID NO: 73 - protein, 568 aa, Methylobacillus glycogenes
MNKLPQAKYIFKLLKFAFNNNPLLYLSVLISILSIGIELLAMASLLPLFELVSGETVDKHGLISKALIILGFTVDAASLLQVFFLLFTLRVVTQLFSQSLTHYLGRRVMAQLGSRAFEKIITSMSIDKISEKSIGFFMGLAGDESFRASTLVVALTQFVATFLLGVMYFISIAIYSLYAAEMIFILMLVSAVFFIWILKISHKMGVRQIEGSRKANSIFMDAMNNIKAVRSLSSEKYVAGLYRRKIFTYANILFYLDAINLATKLVPIIFLLLGSLALILSGWVSVENLGMAYIVSLIAYLMRFFPVVGQSITLAVRIVADAKSGKDVTELVSDESAESANSDNYLHKIDTIKIDNLSFSYRDVQGVRPAVLNSVYYEFEKNNSYALVGKSGLGKSTLLDVLLKFYPPASGSISIDGISTENIPGAHIRHSIVLINQEPAIFDDTVYNNICMGETFTLEDVKWACELACISKDVESLAQGYETRLQYQGKNLSGGQRQRIAIARALVRKPNVLILDESTTALDKATQEIVIRNLMNEYENKIIIFVSHDPYIMSQVDHTVDLALINKV

SEQ ID NO: 74 - protein, 232 aa, Methylobacillus glycogenes
MSISSIALKIFNYSQEIFSFYRDRGLYKFSYAQEGEDLILSRIFDRTSTGYYIDIGAHHPVRFSNTYLFYKRGWRGVCIDPSHEAIALFKTRRPADIALEMGVSDHESELTYHMFDEPALNTFSEELANQRIQNTAYKRVGTRKVPVRPLTKILDEVLLPDTEIDFMSIDVEGFDYQVLASNDWSKYRPRIVLAEALDDVAGERIRSFMIQNHYKVIARTFNTEFYQDLLKL

SEQ ID NO: 75 - protein, 301 aa, Methylobacillus glycogenes
MSNLAPVALFTYNRPDHTKRTIEALKNNTLSAETDLLIFSDAAKNITQQSMVDAVRAFTHTVEGFKSVRIIERQTNFGLAASIIDGVTNVLAEYGRIIVLEDDMVTSPYFLQYMNDSLSQYADFHEVASIHAYVYPIAGLPDTFFLRGADCWGWATWRDRWDWFEPDGSKLFAQLKQLNLLNKFDYNGSYPFSNMLRDQIAGTNNSWAIRWHASAFLLNKLTLYPGKALLSNIGHDGSGVHCGESETYSAELRADRLLLTDIPLRESEPAFKKFEQFFLESKPSVVRKMMLKAKSVFKKFL

SEQ ID NO: 76 - protein, 271 aa, Methylobacillus glycogenes
MSFIKILKLLCPPLFLHILQKYRRRNFASSFAGNYSSWAHAKQNSGGYDAENILTIIQESALKVKRGEAVFERDSVCFHHVEYRYSALSGLLYAAVSSGGKLSVLDFGGSLASFYSQHAAILSIVKDLRWGVVEQPHFVAWGREHLTTTDLKFYNSLTEFILDGKPNVIFLSSVLQYLEHPYQLLEELLRLDSEFILFDRTAFYDVVDRLTVQTVPASIYPASYPAWFISWDKFINTMSAGGYEVIMEFPCADLTDIGYYKGLFFKRKSVS

SEQ ID NO: 77 - protein, 332 aa, Methylobacillus glycogenes
MNDELYSGKNILVTGGLGFIGSNLVKRLIAHKAKVTVVDSLLPLYGGNAFNLSGYESLVNINISDVRDSHAMAYLIKGKDYLFNLAGQTSHLDSMTDPRTDLDINAAAQLSILEACRQHNPDVRIVFASTRQLYGKPEYLPVDESHPIQPVDVNGINKLAGEWYHILYNNVYGIKACALRLTNTYGPGMRVKDARQTFLGIWLRRVIEGKPIAVFGDGLQLRDFNYVDDVVDALLLAAANTEADGQIFNLGSDEVVNLQQVAELMTQFQPGSSYEIVPFPPERKAIDIGDYYSDFNKIKQVLGWSPRVGLQQGLAASLAYYRQHHDKYWDNV

SEQ ID NO: 78 - protein, 366 aa, Methylobacillus glycogenes
MILMNDFKAEPEALIAAQLQAVERVLRSGWYVLGEEGRKFESLWSQRCGTSHTVGVGNGMDAIEIGLRALDIGPGDEVITTAMTAFASVLAIIRAGATPVLADIDPDTGLLSHESVKRCINSRTKAVLLVHLYGQIRDMQSWLNLCDQHQVALLEDCAQAHLAQAEGKVAGSFGRFGAYSFYPTKNLGAIGDGGALVTSQSALADKAAVLRNYGQSVRYHHPEFGLNSRLDEIQAALLTVRLEWLEQYTSHRQSIAAQYRQQLNNPYVRLMQTPTEPLAHVYHLFVVLTEHREALQAHLQANGVQALIHYPVPIHHQEKCSDILRDPAGLQFSEAHAQQCLSLPCHPQMSEQDVQTVIAAVNRFAL

SEQ ID NO: 79 - protein, 313 aa, Methylobacillus glycogenes
MEHFVTLFDSKFLPQGLCLHESLARHARDFHLWIVCMDKVVHEQLEKLQLPHVSLMRLADFESEALLAVKPGRTKGEYCWTITPFTAEWVFAQHPEVARVTYLDADLFFFNDPAILFHEFEQSGKHVMITEHAYAPDYIQHLETSGRFCVQFMVFDRSEASRKVMHWWQDRCVEWCFARMEDGKFGDQKYLDLWPTIFADDVHILKCVEQTLAPWNVDYQLQHQSGKFKPVFYHFHAFRIIKFNLVRLYEGYQIAKSSRYLYDEYLATLQKKIGMLHRFAIPLPLLPEKCGIRPKLASYYTWIRGFTATAKIK

SEQ ID NO: 80 - protein, 255 aa, Methylobacillus glycogenes
MQKLSVITATYNAAKNLPDLVQSLLSQTDMDFEWVVADGGSSDETISYLKSVVGINLLLSAQQDFGIYDALNRAISLSSGDYYLVLGADDILYPHAVEAFKRAAGIGLPDLVTASVESDHGVMIAGSGRPFLRGQLAYISNHSVGTMIKKSLHDRFGYYSRRFPITADQYFIKRVCGASETVIYKADFVAGYYPATGVSGADVPGTMVEFFRVQLETEPNSVLQLVLFILRLIRHTPKLIRYAHYKKLRDLPQHE

SEQ ID NO: 81 - protein, 360 aa, Methylobacillus glycogenes
MNSNVLFITGFHPGGMGFIGAGEAISQQHIERLIKQGRKVHVLALAPNYQVASPEVVASCASYTTLTHTRWMTFAALWRSRQQGSLLCPWLFTRVSPQAERFIRQLLDQHAITEIYLDFPSCLGFAPTYNQLPIHYIVHDVLSQKVERRPLLKWLKNQVLRTESSLLRHVTQCFTLSLKDKLRCEEIGYSGQIEVQVPHILKVGVVNQGVPIAGILKQFPGKKNLVFFGNMQRAENHYSILRFLLCSYPGIWLEHRDVQCWILGLAPRTLLRWISKVLPGVRVTGAVDDPTEAFKAATLCIAPVYYGAGVKIKVLQMLESGATVISTPVGAEGIHGSEKLITVESARLSSTIKQRLAVES

SEQ ID NO: 82 - protein, 307 aa, Methylobacillus glycogenes
MNQHELPSVAVLLASFNGRAWIAEQLASILAQQGVKLHVFIADDLSTDGTWEWLNVEAACHQNVTLLPHNQRAGSAGRNFYRLIHEVDLDGFDFVAFADQDDVWDSYKLSRHARLMKLHQADGVSSNVEAFWPDGRVMLIVKSQAQRQFDYLFESAGPGCTFLMTTRLAHQVRNVLQDELSPARDVTLHDWLTYAIARSLGYTWVIDANPSLKYRQHGNNVIGANVSLKAKWTRLKQIRDGWYRQQVIKVTRIAYAFSQREDLQRLLVLLEKPSLGNRLQLLPYAWHGRRSVKDRLFLMFSIVFKWF

SEQ ID NO: 83 - protein, 317 aa, Methylobacillus glycogenes
MSQQHILVTGANGFVGRSLCNQLCQSAFQVTQVGRALNSADGGAYSQVVSIDGTTDWSTILDEVEVVIHLAARVHVMQENLVDPIVAYWQTNVEGTLNLARQALNAGVKRFIFVSSIKVNGEQSFPGKPFTAEDMPMPEDAYGKSKWEAEQGLLALAKDSNMVVVIIRPPLVYGPGVKGNFSTMIKLLQTGLPLPFGAIANQRSLVAIDNLIHLIMVCINHPAAANQVFLVSDGEDLSTTALLRRLALAAGVSSRLIPFPAAWVNFVFTVLGKKMMAGRILGSLQVDISKTREVLGWQPPVTVDQGLRNCFPTKAEP

SEQ ID NO: 84 - protein, 183 aa, Methylobacillus glycogenes
MIRFFDIVFSLLGLVFGLPLLIIIYLVGLLDTGSPLFRQVRVGRHRQPFTLVKFRTMKVNTASVASHLASASSITWLGSFLRSTKLDELPQLWNVLKGEMSLVGPRPNLFNQDELIAARDARGVYAVRPGITGLAQVNDIDMSMPKLLAETDASMLQQLNLKLYFKLLIQTVLGKGRGDRVVR

SEQ ID NO: 85 - protein, 573 aa, Methylobacillus glycogenes
MLAWWVAFLFRFNFDIPAPFAESMLQSAAWVIPLQATFFLLCGLYRGVWRFASLPDLQRLIRAIGVAAVVVVAILFMFQPHGVVPRSVLIMNPMLLLLLMGGSRIAYRAWKEHRLYGAAQSSGKPVLVLGAGDAAIALLKDLSKSHEWRIVGLLDDKQSMFGRELLGVKVLGKLSDFPEIAKAMSVQHVIVAIPSARNNAGARLLIWPVSTNSRYLPCHHWKIVGVSAWRSYVRLRLKICLGVSLWCWTMMVCTSSIVRWLWSLARAARLVQNFADSYSSFSLQCWCVSTIRSFLFIASKNPLSWMCGLNIWGTSRMHDACSTCLLVISQHSISCCSLTCAYDGKPRCRVIIQCAGYFHSSQCMGGGRVCAGIHRSGPNQCHGGQTSGNGVSRFAGGNRNPLCGSAFRQCAGQQWCDPVRANCAWWASHRYSSRDHALFHVYTGVPVGHASRIDGGRRNIRARYGPHQDCGLGACYDVVRVGGGRHCFFRPAPWREAVRGTFGRRRTHFTDAARIAYRRGKCRGLGCGFAQVGRQVIQHGGSREARAQDVGGGVCRYTCSFFCVDSRVIDNTL

SEQ ID NO: 86 - protein, 291 aa, Methylobacillus glycogenes
MTKKITKAVFPVAGLGTRFLPATKASPKEMLPIVDKPLIQYAAEEAVAAGATELIFIIGRNKRSIPDHFDKSFELEASLEASKKTKMLEEIQNILPKHVSCIYIRQAEALGLGHAVLLAKSVVGNEPFSVILADDLIDAEKPAMQQMTELFEKQGASILGVEDVEPSETASYGIVDAVELTGPDVLQLNGIVEKPQPEDAPSNLAVVGRYILTPEIFTCLENVKPGKGGEIQLTDGIAALMEQQKILAYRFKGKRYDCGSKLGYVKANVEFSLKHEEIGEEFSQYLRELTK

SEQ ID NO: 87 - DNA, 774 bp, Methylobacillus flagellatus
atgtccttaaataaaaacttaaacgatattgagaaaagccagttaattgagctaatgcatgaatctttgagaattcgctcgcactttgagctttttctctggatgcagggaaaacttcaggttttcctgccgcatgaaatcatgataacggcttggggagacttttcacttggagtcatatacttcaacattgtttcccccctgccaggcatccgctccgacaagattgccagtcatgaaatcaatcagttcctgcaaaacctgttcaactattggctgaaccatgccaaggcccctttcacgctcgcagcagccgacaacatcctgcatgactgcgaattctctaacaaagaatcaagctattacttaaaaaacatgaaatcggcattggtgcatgccatcaaggatcaccgtggcaggcatgattgcctttatgtattgcttagctccaacctgagcttccccccagcctctcgtcccatgctggaagcgcttctaccctatatcgatagcgcattgcggcagatagaacacttgccggagcagcaaccgacactgatcaaggcagaacccgagcccaaggatgaaagcctgaatatcctttccggccgcgagctggagatcatggactgggtcaccaaaggcaaaaccaaccaggaaattggcatgattcttgatatcagcgcctttactgtcaaaaatcatttacagcgcattttcaaaaaactcaatgttatgaatcgtgcacaagccgtcgccaaattccgcaaataa

SEQ ID NO: 88 - DNA, 507 bp, Methylobacillus flagellatus
atgtatcctgatctggtgcatctgggcggtgcggataaatatttcgaggaaatcctcgagattgtaaataaaatcaagctgttcggggacttttccaacgaggaagtgcgttatttgtgctcctatatgcagtgctatgctgcacccagggactgtcagctgctgacggagggcgatccaggagattacttgctcctgatcctgacgggagaagtgaacgtcatcaaggatattccgaacaagggaatacagaccattgccaaggtcggggctggcgccatcattggtgaaatgtcaatgattgatggcatgccgcgctctgccagctgtgttgccagcttgcccactgactttgccgtgctgagcagggatgcgctatatcaattgctggccaatatgcccaagctaggcaacaaggtgctgatcaggctgttgcaattgctcactgcaaggtttcgtgaaagctatgacaggattctccccaaaaccctgggtgagttgatctga

SEQ ID NO: 89 - DNA, 678 bp, Methylobacillus flagellatus
atgtttttatcccgtttacatacgccgatcctgagccgtgtagcgccatttgcattgtatatgctcttcatggcagtggtggacttggtagtccggatcggcttggtggacgccgatacgcgttggctctatggcatcaaggtcgggctggtcgccctattgctttggtatctacgcaagcagtatgtcgagctccaggggctagccgcgctgggagccaggtcgtggttgagcgcaatcgccgttggtatgctagtatttatcgcctggatcaatctggatgcgccatggatgttgattggcgatcaatccgaagggttcgatccgggaagcggaccggatgcccgtctgctgatggcgacaagagtgatgggggccgcattggtcgtgcccttgatggaagagctgttctggcgttcattcttgatgcgctggattcacaaccaacatttcctcaatgtcgaccctcggcaggtaagcgtcctggccttactagtttcatccgcattgtttgcaatagaacataccgaatggtttgccggtttagtggctggcttggcatacggcttgctttatattcgtagcggaaaaatatggttgccgatcatcgctcatgcggtgacaaatggcatattgggactttggatcatatataccggtaactggcattactggtaa

SEQ ID NO: 90 - DNA, 1233 bp, Methylobacillus flagellatus
ttgcggttatctcaatcaactaacctaataaaaattgctttggtcgctgggctaggtatcgagcttgctggatttgtagtccctgcttgtgcattagagggggatgttttaaagccgtatgccagtcttacatattcatatgatgataatttaagaagattcgctagtaagcaattagctcaaatgagtactgggagttcagatacctcagatacaatgcttgtcaaaagcgctggtattgtgctggatcatactattagtcgtcaaaaaatgtatgtggattttagattaaacaagtccacatttaataaaaactcagagttagataatgatggtcgtgacgttattgccaggtgggattgggagttgggaaatcgattggaaggcaaggttgagttttttcataaaaaagctttggttcctttttcagaattccaacctctgcaaggaaccatgttatcgttaaacacaagaactcaggaccgccgcttattggaggcgcgttggatgctgcatcctagatggcgtgttagaggggcttttatttactctgaaatggagtacggggctgaggctcaaagggccgctaatctaaaggaagatatacaggagatcggatttgactatctatctcctactaaaagtatcatcggtgttctgtacagaaatactaaaggatcaaagccgcagcaagcttttcagggatcttttataagcaatgattatgaccagaatgaattaaagttgaatgtcgattgggctgttaccggaaagtcaaggttgcagtttcttggtggtttggtagataggcagcatgagcaactgtctcaacgggactttaggggggttaatgctcggggaaactttaattggatgacttctggaaaaaccaatttgaatgctgcagtttggagagaaaataacgctcagtcatttgttacaacaagttatacgctgaatcgtggaacatcattaacggctaatttgcaggcaactggtaagatagctgttcaaggcgtattgaaatatgaaaaaagagattttgagggggatcaaatttttggtcaatttaggtcagataaagataagagttttatgctgtcacttatgtataacccagtaacatcttttaggataactacttcatttattcatagtgatcgagagtcaacatctgatatgtttgaatttaggtcaaatagtgtctcagtaacagggcaatatgagttttga

SEQ ID NO: 91 - DNA, 1386 bp, Methylobacillus flagellatus
atgacggtaaatgacatacctttagtcgcttttttcaagcagctgttagatcctttaattattctggggactttgtatggctttacgcttctttatggtgagccattcaatggctactacttaatccttgcgttgcttgcatactttgtatcttcaaatgtctatgagcgcctggatctttaccgcacatggcgtagtggaaaagtgttgggctatattcgtgatattttgttcggatgggcaattgttgtcaccatattggcatttatcggatatgccgcagaccttactgatcagtaccatgaggaaatggtgtatacctggtttgtggcggtgccgatcatctttactgttgcgcatttgctcatccgcaaaattgcctcggatttgcataaaaatggcgaagttcgttctgttgtcatagtaggcgctaatgatatcggtgtccggttggtgaatcgcatcaatgaagacccttacctgttcatggaggtgaaaggtctttttgatgatcgcgagatatcccggcatcccaagggaatgcgtcatgtaccgttgctaggcacaatggcggacgtggcggcttatgtgcgtgccaacaatacccagatcattttcatcagtctgccgatgtccgcgcaaccgcgcatcagacagttgtttgaggagctgcaagacacgacagcatctgtctattttgtgcccgatatctatatttttgatctggtgcaggcaaggtttgatgatgtggcgggtgtgcctgtggtggcgatttgtgaaacgccgtttacagggtttaatagcttaatcaaacggactagtgacattattcttgcatcccttatcctgttgttgctttcaccgatcatgctgacactggctttggctgtgaagctgacttctaaaggcccggtaatattcaagcagcgtaggtatgggttgaatggtgaggaaatcattgtttacaaattccgctccatgacagtgatggaagatggtgacaaagtggtgcaggcacaaaagcgtgaccagcgcctaacaccgattggtggttttctcaggagaaattcccttgatgagttgccacagtttatcaatgtgttgcaggggcgaatgagtatcgtaggcccgaggcctcacgccgtggcgcataatgaacaataccgcaagctcatacgtggctatatgttgcgccacaaggtgaagccgggaattactggctgggcccaggtgaatggattgaggggtgaaaccgataccctcgaaaaaatggaagcgcggattgaatatgatttggattatctcaggcattggtcgctggcgttcgatctctggatcatcatccggacggtgctggtagtgtttaaaaaagataatgcgtattga

SEQ ID NO: 92 - DNA, 945 bp, Methylobacillus flagellatus
ttgaatactgaatatggaagcacaataatgcaatggtcgaaaatgacgaaaggggcgttggtcgccttgatgattagtatcgggctgtcgggctgtggagataaatctaatgaaacaaaggctagccaatcgctggcgagagtgaacggcaaggaaataaccgtccatcaactcaatgaagagcttgctcgggccaatgtccagccagcgcagaaagaagctgctaccaagcagatattgcaatcattgattgaccgtcaactgttggagcaggctgccttgaaagcaaaagtagaccgggacccgaacgtcatgcaagccattgagcgcgcaaaatcccaaatgattgcccaggcatacctccagtctagggtggctaacataggcaagccggacaaaacagaagttgagaatttctataagcaaaaccctcaactattttccgagcgcaagctggtggaaatggaacaaatattgattgattcacgttatgtcaatgacgaattcaagtctgcgctcggtagcttcaaaaccctgcaggaagtcgctgcgtggttggatgctaagggaatccaatatgaccgtggagaagttgcccgcagtgtggcagagctgcctccacagatttctgagcgcctgaaggatgcaaggcgtggccagctgtttgtgatcggcatgggaccgaggacgatgctggtgctcatggatagcgtaaaggagagcccggtatcactggcagatgcgacaccgcaaattgagcaaatgctcttgaataaaaagcgtaaggaagcgggtgaggctgaaatcaagcgactacgggctgaagcaaaaattgaatatttagacaaatcggccgaagtaccacaacaaccagaaaaagccgaacagtcaaaaccctctagtgtcgatgatgatattgctcgcggagtaagcggactaaagtag

SEQ ID NO: 93 - DNA, 813 bp, Methylobacillus flagellatus
gtgtataggtgtagtgccatgactaaattgatcaaatggtttgtaacggtagtcctgacgattgttgtattcaatgttaacgcagcggattcggatattgttcttgggccgggggatgttctaaggatatctgtatttgaacagcctgatctttccttggaagtaagagtgagtgagtctggcactatcacctacccgttgataggcgaagtcagagtcggtggagaaacacctgcagctgctgaacgcaaaattgccagcatgctggaaagcggtggattcttgaaaaaccctcacgtgaatatcattgttgctcagttgcagagtcagcaggtttctgtgctaggtcaggttaacaggccaggtcgctacccactggatagtgcaaaatctcttgcagacgtactggcgttggccggtggagttgcacctgatgggggagatttgattagcttggttcgcaagattgaggggaaaagtgttagagagataattgattttgctgaaatgatgcgggatggcgacttaaataaaaatatcttacttacggcaggagatattatttatgtagatcgagctcctagattctatatatatggtgaggttcagcggccaggacaatatcgtcttgagtatcatatgacagtgctgcaagcactcgctgttggtggtggccttagtctcaggggaacggaaaaaggtattaaggtgaaacggttagatgatgaaggtggtgttaagataattaaagtaaagcatgatgattttattcagcctaatgatgttgtatatgtacaagagagtgtattttag

SEQ ID NO: 94 - DNA, 1410 bp, Methylobacillus flagellatus
atgagttttatcagatttatttctatcattaaagctagatataaaattattatttttactttatttataacggtattaactaccgctattgttacaatattgttgccaaaaaattataaagcaacagcttcagtgcttgttaattataaaggcgctgatcctgtaacaggtgtaatgcttcctgcgcagttaatgccaggttatatggcaacgcaagtggatattatttcaagtaaaaacgttgcaaaaaaggtaattgataaactaggtctggcagatgttccagccgtaaaagaggacttttatcaagcaacttcaggtaaaggtgaaattaaagaatggcttgcagatttattgctaaaaaaacttcaagttaaaccatctcgagagagtagtattattgatattagcttttttggggtaaatccccagtttgcagctacaatcgcaaacgaatttgctgagtcttatatgcaaacttcaatacaacttaaagttgagccttctcaaaaagctgctttgtatttcgttgagcaattgaaagaactgagagaagatctagctcaagcgcaatcgaagctttcagagtatcagcaagagaaagggattgtaagtgttgatgaaagattggatgtggaaagagccagattaaatgagctttcatctcaattggttattgcacaagcacaagttatggaagcgagatctcgggaaaaaaattcaagtggaaaagaagcttatgagtctcctgatgtagcagctaatccaattatccaaaatcttaaaactgaaattgctagagcagaatcaaggtttgcagatgtttcgcagaaatttgaaagaaaccatcctttttatctaggagctaaagcagaaattgaaaatcttaagtctgagctagatagacagatcaaatcggtttcaagtaatgtggcaagtaattcaagaattctgcaacaacgtgaagcggaaatacgtttggctttaaataatcaaaaagaaaaagtattacaacttaatcgagatagggatattttatctgttttgacaagagaggttgaaaatgctcaaaaagcatacgacatggctatgcaaaggtatactcaaacgaatattgaaggtcagtcaaatcaatctgatatttctttattgaatcctgccgtggcacctcttactcccactagcccaaatttattgctgaatattatattgtcaatcctcttgggtatgtttttaggaatagggtttggagttttagctgagtttgttgatcgaagagtacggactgctgatgacttaattgaagtattacaagccccacttcttgggactattagtaaagaaaaaagaaaactgagattttttaaaaatacttcaaacctgataactttagggaaggctgaattatga

SEQ ID NO: 95 - DNA, 897 bp, Methylobacillus flagellatus
atgatttcatttacaccttctaattcaaactctgaaaaagtagaaaatgcaccattggtaaacgaattttcagaatttacaattggtagtttattattgcggatggggaaaattacacccgaagatgctgaaagaattatgcggttacataaagagaagggtttgcgctttggagaagctgctcaagcattagggttgataactgaagatgatattcaacaggttttatcgaggcaatttaactatccttatttatcacctgaccaaaactcatatcttaatgagctcgttgctgcatatcagccttttagtaacaaagctgaggttttgagagcagtacgcagtcaattaatgctgcattggttttcaccggaacgaaaagcactagctgtttcttcagtaagcagcagcgataatgcaagctcttttgttgcaaatcttgcagttgtttttgcgcaattgggtgaaaatacattattgattgacgctaatttacgctacccacgccagcatgagatatacaatctgagtaacaaacgtgggttatctgatatcttagcaggaagagcggggtatgatgtaatttcaaaaataaatttttttgaaaacttatctgtattaactgccggtacattacctcctaatcctcaagagcttgttagcaagccaacattcggaaatttaattaaagagttggcttgtgtttatgatgtaattttattggatactcccgaacttagtaattattcagatggttatgcaattgcttttactgttggaggaattgtattagttgcaagacaaaatcatactcgagtgaatgatttatctattgctgtagaacaatgcaagaataatggtactaaggtaattgggtcaatattggttgatttgtag

SEQ ID NO: 96 - DNA, 888 bp, Methylobacillus flagellatus
atgaacactgtcgaggtaatcgagcaagataatcctggtatctgggaggtaatcaatcggaattggatgctattattaggtttgttcattatgtatacgcctacatatttgaacttattaaatactgtatggcaatctgaagatcaagctcatggaccattaattgttggcgttgtcttgtatttagtatgggtacagagacaccaattgtttaaggccgaaaataatattataggcaggccagtaattggcgggatagttttagtttttggtcttttactctacattcttggccgttctcaagatattgcaccgttagatattgcatctcaaattcctgtttttgctggattgttgctaattttccgtggttattctgggcttcgagcattgtggtttccgttattcttcttgatttttatggtgcctcttcctggagtttttcttgatgctgtgacattaccaatgaagattgcggtctcatatgtagcagaaaatatactttattggataggatatccgatttcaagaagtggggtgatcctccaaatcggacaatatcaattacttgttgcggatgcatgtgctggtttgcacactttaatatctttggaggcgctgggtttactttatttaaatgttgtaaagcacgattcatttattcgtaatgtaattcttgggatattgattattccaatttcttttaccgctaatgtgattagagttatggtattaactttagttacttatcattttggagatgctgctggtcagggttttgttcatggttttgctggaatgttactttttgtagtggctctaattttgataattagtgttgatacgctcctacaatatttggttaaaaaatggcagttaaaagcctaa

SEQ ID NO: 97 - DNA, 681 bp, Methylobacillus flagellatus
atggatggatttacactgcgaaatttaattatatttttactgttattggtagctactttaggaggagtaattcttaaacctactaagtttgttaatgcagcagaagatataaatttagaagcaatgattcctaaggagttcgatgagtggaaaatcgatcctacgattactcctatacaagtgagccctgaggtgcagcaaaacctcaataaagtttatgatcaaactctttctcggacctatattaataagcaaggaatgcgaataatgctttcgattgcttatgggggagaccaaagtcgcggcttgcaagcacataagcctgaaacctgctatacagctcaaggatttaatgttgatttgttgggtaatgccattttaaattttgatggatatgaaattaaagttagacatttattagcccagcatggggcacgatatgagccaatactttattggatgcgtgttggtgaaactacagtttatggtggattgggtcaaactataaaaaggtttgaattaggtttgcagggatatattcctgatggactgctttttagagtttcaagtattagcagagataatatctctgcttttacactgcaagaagaatttgttaaatctttactgaaaaatgtagatagtaaaagtagaaaaaaacttataggtacattttcataa

SEQ ID NO: 98 - DNA, 1287 bp, Methylobacillus flagellatus
atgattaaacataccgcatttatggctctttcgactttttcacggttgctatcagcggttgtacttttcattattcttgcaagattccttggtccgagagactttggcatattgatgtacaattttactcttgcgtcaatagctgtgcttttagtggaatatggattttcaaatcagttgttaagagatataggaagataccctgataatattaatcagttaatggggagggtttttcttgcaaaactatatctcacagtagtgatgggggtctgttgccttgctggacattacttattctatacaaatgacttagatagagcaatattttggattttactgttatcttgtttgctcacttcttttggggatttttttaatattgcattcagaggtatcggaaaatttcatgaagaaacaaaagttgcaacaattggctctttgttgcatttcggcttaatagttttaatggtaattaatggggctgagttattattaattagtttaggttttgttttatctcgttttgtttattttattttgtcgtggcgggcatataagcgagtggttggtgatttaaatactctgtcagcctctccagttgctgttctaaaagcattaaaagcaggatttccatatgccgttgatgcgggtttcactaactttttctaccaagttgacaccatgcttgtgaaatattatctgggagccactggagttggtatttaccaagcaggtatgagatttctaaatggtgcaatgcaatttgcacctgtactcggaaatgtatttttacctgtaattgctgccaagcacactaatactagagagtttgttgagctagctaaaaaacttaatcttcagatgcttgctgttggtactgtgtgctgggctattttctggtttgccggtatgcatattaccgaatttgtttttggtgatgaatatgtagagttaaattcaatttggccctatattggtttgttagtttttacaagatatcttgctgcgcctcaaggtgttctattgactgcttctggatctcagacaatacgtgtctgggcacaaatttttgcacttattattttgctaatttcagcaccacttctgatgaaagtgattggactaaaaggtatggtcattgctttaatcatcacattattaaccttgtttttgatatttttcagtgcattacggcttagaaaaatacctactgggtttgggggagttaattttactttgactgtaatagtatttagtctttccatttttcttttggtatattag

SEQ ID NO: 99 - DNA, 1179 bp, Methylobacillus flagellatus
atgttgaaaataggcttactttggcattctactacttcagataatcttggtgttggcgctttaactgaagcacaaatttctattattaataaagctgcggtgcaggcgggggttgaggttgaatatcgaattttcggcactaatggaaacaaagattactttgagggcaaccctttaattgagcgagggacaaatgtatcactcaaaagaattttgatcggggcttctgattatcccaagaaaatccgggaatgcgatgtggtgtttgatataggtgaaggtgatagttttgctgatatttatggtttttcacgattcctaatacagattgtgtctaagttggttgtcttgtttcaacgtaaacctcttattttaagcccgcaaactatagggccattcgaaagtaggtttaatttaaaggtggccaataatgtaatgcagcggtgcactaaaatatttgtaagggatggattgtcatttggatacttgcaaaagaataatttatctgtaaatgcagaggaggtaattgacgttgcttttagattgccatttcaacgcccttcccgggattcaagtaaagtaaaaattggactaaatgtatcaggattactttataacggtgggtatactgggaagaatcaattcggtcttagtgttaattatcctgaacttactagatcactattagatcagtttactcgaatagaaggttgtgaagtatggcttgttcctcatgtgctaacgacctcatttcctatagaagacgatgtgaacgtgtgtgttcaattacaagagctttatccagctgctaagcttgcaccatctttttcttctcctagccaagctaaatcttttatttcagggatggatttttttcttggagctcgcatgcatgcttgtatcgcagcattttcaagtggagtgcctgttgtgccattagcgtatagtaggaagtttaatgggcttttttctgccttggattatccttatcttggggattgtaaggttaatactaacgagcaaatagttggtttggttatggattgttttaacagtcgggagcagttgaagtttgcagtagaagaaggtaataaaattgcagaaaaaaaactattgcgttatgagcagtacatagcagaattattaactagaatttcaaataaaaagattgttttataa

SEQ ID NO: 100 - DNA, 1023 bp, Methylobacillus flagellatus
atgtatagttgtaagatgaaaaaatacataattggtttcttgccgctttctattaaatggcttctgagattttgtcttcgaggcccgagtttattgagagacttttgttacgatgctaaacgatatattaaatggtcatctgtaatttctttcgagaaagatcgtgaaaagattcttgcggttattactgctacttatcacaacatcgagaaaggaatgtctttacctaatcccaggccgttatttggaagggtagtgattggacaattagttggatcagtcgataattttcatcttaattttgggcctgatccacagctagatgttccgataaatgtactggcgcgttattgtcaatttaatagaagtcttggtcagccagattctcaattagaagtaatcgttgatcggttaaagaaaaataatcagagcactttattaaggattaatgatggcggggttattttgcgctctaaagctgaggttttagacgcaatatctggggttaaagaagatttttttcttatgcgccatagtgtaaggcagttcactaaagatcctatagagcatagtgtaattgaaaaggccgtacgtattgctcaaaaaagtccagcagtttgtaatcgacagtctggaaaggtccgggcaattcttaatccagaattaattaggagtactttacaaattcaagggggcgcacgagggttttatgaagaggttcaggctttattttgtataacagtggatttgtcaaattttaatggggcggaacgttatcaaggttggattgatgggggaatgtttgcaatgagttttatatatggcttacatttgcaaggcctaggaagttgcgctcttaactggagtaaaactaggaaacaagatatagaaatgaggaatcaccttcgtataccagaaaacgaattaattatcatgtttgttgccgctggatatttaagggaatcatttgttgttccgcaatcataccgaaaacctttaggtgaagtcttgagttatatttaa

SEQ ID NO: 101 - DNA, 1473 bp, Methylobacillus flagellatus
atgaagaacaattcttctctcttatcttttaaccgtagggatgctaatttcgttagtttaaagatagggagtatattttttgtaataatggctgcaatagtggctttgatatttggttttgtcagtgctatttttccatggtggtggatagtagccattattctttctatattatttatttttattggttttacatatcctttagtagctttaatagctgttatagcaatttcttctagattaattccagatacatttttgccttcaataagactgctgggaggcacaataccatcttcagatatggccttgtttgcaacattcattttttgtttttttaaatacaattcagaatttagctttacaaagcaagcattgtcacctttggctattcctttatttgttgtacttttactgttgcttttttctgtatttcgggcggtgtttgaaattagattgccattgaaagatattttaggggagtcaaggcatttcctttattggctattgattcccttaatagctttaacatgctcagatagacaaagatttaaatttattgtttttggctttctttttgtagcttttttattttcaattggccagattttgcaaggttttctaggtgtaaatgtgttcgggcgcgagcttactagccttgaaactttgggaagcattaatagtgatgttacacgaagcatgacgtcaggaactcacattattgtttggggatttttgtttgtactggctttgtttgctaaccgaataggtttttcaaagactcttattatattgtgtatatttacaggcgctggaattttcttaacctatggtcgtgctgtttggggggggactttcttagctgttttgttcttatgctggaagctagggacaaaaaaaatgcttagaagtgtaggactaattgcaattgttgctgtatttggtttaagtgctatgctagctattaagccgggcgctattgaaggcgcgatgcagagattgtttagtgtggaggaggaggtttctcatggatcttctctcggctggaggttttatgaaaataaaatggcatgggcggcaattcagcggtcacctttattaggcattgggcttggtgccccttataggccgcctgctaaatctgatgtgacagcagagcaagtgagatatgttcatagtgcttatatctatttaaccttaaaaacaggcattattgtattcatgtcagtcatttttcttatattcaaaatacttcatttaacttacattcaaacgcggtctaatgatttatttatatcaagtgttgccatagcttcttttgctgcaatgatagagtattttttggcctgcattactcagccagaattaatgcaaaccccgggaattgcttttttggctactcttgctggtcttatgtgcgcggctaattatcttaatcaaaaaaatcttacaaaaggaaagctaacttcttaa

SEQ ID NO: 102 - DNA, 807 bp, Methylobacillus flagellatus
atgaatgttaaaacatctccattaattagtattattacggcaacatataattcaatgaaatattttgaggatactaaaaaaagtgtccttgaaggagatgttgaagactttgagtggattatcgttgatgatggatccactgatggaacgcggaaatatttacaagaaattgatcatccaaatataaaattgcattttaaaagtattaatgctggtattgaagactcatatagaactggtattgaattggcgaccggtaaatatttgctaattttagatcacgatgacactattccattgggatctttgtcaaagcggcttgacttactggaatcaaatcccaatgctttggctgcatttggtgctgtggcatatatggatgagtctgggaggatttataaagaatcacgttttccttttgtatcagatgattgcgtactgtcatcactatttactttattcggaatctttattttaccagtataccctttaaagcaagggtgtgtggttttgaggtcttctttcgttaaaaataatccagggttatatgacatacaactattcctgcaagctgctaaattgggcccagtaatatttatcaagcaagcatgtttaaattatcgaacatttagaacgcagttttcaagttctagaaaaatgcgattgattcgtttttttcaatttgtttgggcaaaatatgcgtttaaatttctcccgtggtatataagcccgttctttgctatttataaaacaataccagagttctttaaagtattatggagttttgtttcttcaaaacggatttaa

SEQ ID NO: 103 - DNA, 969 bp, Methylobacillus flagellatus
ttgatgacggattttagttcaaaaaaaaagttagacttaagtgttgcaatagtttttgttaattataatactagtgaccaaattatttcttgtatttactctcttagggaagagagatattcaaagattattgttgtggataatgcatctccggatgattgtcctgagtgcatcgtagaagagtttccagatgttgtacttattaaaagtgaaaaaaatcttggctttggtgagggatgcaatattggaaaagattgggttatagttaatacagattgtgaatatatattttttcttaatccagacacactagttgaacctggattattacaattactgcatgatggattttttagccctgaagttggattggttaccccaagaattactatgatgggtgatgggttggatatactttggtatggtggggggtatatgaactggttaactggttcggcacgcgtaccaggttgtggattaagtgctgtatcaaaaatagctctagaagatcgatttgtagagtttgccagtggttgcgcttttatgattagacgttcagttttagaagagtgtggcgggttcgatccacgctattttatgtacgaagaagacgtcgaattatctttaagagtaatttcttatggatataaaatttattatatgccaaaagctgttgttcgccatctggctcagggtagccagggcaaagaggtagaggctgttggtatgtttaaaggaaggaatcctaagcttcctttttttgtttatcaaactgcgaaaaatagatttttaactgtttttactcatggaactgtgcttaagaaaggtctatttttaataggttttatgttatgggtgtttcgaaactcttttgaatgggtcagatataagagacttgatgcatataatgctttatttttgggcattaaagattttgttaaatacacatatgtatcaggtaaaaaataa

SEQ ID NO: 104 - DNA, 1149 bp, Methylobacillus flagellatus
gtgaaagaaattaacgtcgcctttgtggagccagttggtagtcacggtggtatggactattatgattctggactgtgtgccggtttgttacatcagggagtatctgcaacttggtatacctgtgacatttctaaaccttgtggtaatagacctattttcatgcaacttacttttgtaaatatttggggaaaggatgctacgtggagaagaggggctaggtatatcttagggctttgtaggagcataaagcatgctaaaaaaaattattcaaatattgcccattttcatttttttcatgtgggtgttttagaatttttaagtgtattattttttcgcttatttggatttaaggttgttgctacagtgcacgatgttgagtcttttaagccgggtctaaccttctctatcttgttaaaatggacttactttctctgtaatcaattaattgtgcacaatcaagttagtaaggatgagttgattaatagaagtaatgtttctataaataaaatacatgtaattcctcacggaagttatattggtctggttgcaccctcgatgccaaaagcagatgctcgtcaagctcttaatgtatcatcagatgaaaaggtaattttattttttggtcaaatcaaagaagtaaaaggtttggatttgttgattgaagcgttaggtttggttaaagataaactaaaaccatttaagctagtcattgctggaaaagtgtggaaagataatttctctaagtatcaagaattaataagtaaaaacgggctaaatgatttttgtaaattggatattagatacataccagatcaagagatatcaatgttttatagtgcggcagacttgattgttctgccttatagaaaaatatatcaaagtggtgttttattaatggcaatgagttatggaactccagtgttagcttcagaccttccgggtatggcgcaaattataaatgatggggaaaacggatttttgttttctgctggaaattatattgatcttgctgaaaagcttgtaaaaattttttcttaccatgacttatctaggattactttgcaagcagaaaacgatatgagaactcgcttcagttgggatgagattgcgataaaaactatcagtgtttatcagaaaagtatatcgtaa

SEQ ID NO: 105 - DNA, 1506 bp, Methylobacillus flagellatus
atgcaattaattaactctcgaaggattgttttacttagtttgttttcccttatgcctttggttggtattgctgaagtttataaatctacagatgtagacgggagtaccacttattctgatacccctcaagctaattcacaaaagataaaggtttttccttctgattataagaagaatgttaaatctgaggctgcagctaataaatccagaagtaattctatttctgctgctaatgttacagaagctcctattgatgagtctagtagtgattctaatgtaactataaagcattcaacatctaataaatctatcaattcaagcaatccttctgctgctggtggctcttcttctgctggtggctcttcttctgctggtggctcttcttctgctggtggctcttcttctgctggtggctcttcttctgctggtggctcttcttctgctggtggctcttcttctgctggtggctcttcttctgctggtggctcttcttctgaaacaactacagctgcttcggtcgataaggtttctgcggctttgcaaggaccgaaagcttttcttaattcagacgattttaaagaaaattcttatcgagggtttaatgttcttgggcggaaattaagttctgctgacatggaagatcttgaaaagtttaacgtcaatttaattcgaagcgttattcatttggaaaaatgtaaaaaatgtaatgattatgaaatttctccagttgagttgtcgcaaatggattttcttgtggaggcaggtcgtaagttgggattttatgtaatttttgcttttgatcctaaacctgctggagatcaggcgatctactggaataatcaacaattacgagaaagcattaagaataactgggtaactattgctaaaagatacaaaaatgagactgtggtggcagggtttgacctgattaatgagcctgttgttaggcctggatcagtatgggaaaagtatgctactgaattgattactgccatacgtaaagtagatgaaaatcatataatttttctggaacctagtccttgggggctggcttctagtttggagcagtttactcctgttccatttaataatatagtttacagctttcatttttattctccccaagaacttactcatcaaggattggcggcatacccacatgcatatatatatcccagtgaaaagtgggataaagaatacctaaataatcgactagacattgctcgtaattgggctaataaatataatgttcctctttatatcggtgaatttagcattattcggtgggctccgtctggttcgaggttacgttacttgacagatgtagttgagcgctttgagcaagagaaatggtcatggacatatcatagctatagagaatatagcggatgggatgcggaaatgccagatagtatattcaagaatgatgctattgtcgaacgtcaaaacaatgttcctgtacttcagcttttgatgaaaaattttaataaaaataagaaatattag

SEQ ID NO: 106 - DNA, 1107 bp, Methylobacillus flagellatus
atgcataagaaaatagcaatattaggaaccagaggaattccggctgcgcatggtggctttgaaacatttgcagagcatttggctatttatcttgaaagaaaagggtggaaagtaacagtttattgccaagtagatggtaatgggcctatgtatgaggatatgtggaatggtataaagcgagtaaatattccgatatctatccagggttctttaggcactattctttttgattggaagtcaacgattcatgcttcaaatacttatcatcttattttaactcttgggtataacactgctttattctgtgggctctatagaactaaaggaataactaatctaattaatatggatggaatcgagtggcatcggaaaaaatggggggcagttgctaaactctggttctggattaatgattgggctggttcaattttaggcaatcatctgattgctgatcatccgcaaattgcgcgtcatctggaaacaagagtcaggcctagcaagatcacaatgattccatacggcgcagataaagtgattgaggcgaatcaggccgttttggaggaatatggacttaagcctttcagttatgcgatcttaattgctcgtgcagagcctgaaaattctattttagaggtggtgaaagcctggtccgctaaacctcgaggcatgaggcttgtagtgctaggaaaatataaccctgaccatgcttatcaggtcgcggttaaagctgccggctcagacgaggtgctttttcctggcgcaatttatgataaacacgtggtcgaatctttacggtatttctcaagattatatattcacggccaccaagttggcggcaccaatccttctttggtggaggcactaggggctggtaatgcagtattggcgcacgataaccgttttaaccgctgggtcgctggagataaggcggcctacttttctggtgaaaaggactgcgaaatcactcttgatgagcttcttaatgatgaagttcggttacgtgagatgagagccggtagcttggctcaatacgataccttatttacctgggactcagtgttgcagcaatatgaggccttgctgacaaggtttttgccaaataagtaa

SEQ ID NO: 107 - DNA, 1440 bp, Methylobacillus flagellatus
atgcagattcaagccgtgattttatcaggtggctctggcacaaggttgtggcctctttctcgagaaaactatcccaagcaattgctgacattgcttgataatgattctttacttcagtcgacattacgcagggtcgatccactcattggaaccgagtgttctccaattctggtatgtaatgaagaatatcgctttgttatcgctgagcaattgcggatgatgggaaggcgtggatctattctccttgagcctgtaggcaagaacactgcccctgcgctcaccttggctgccttagaggctgccagccacggccaggatccaatcttacttgtcatgcccgccgatcacgctattatcaatgtgcaagactttcaggataccgtgaggacaggggctgaacatgccgctgctggtaagatcgtcaccttcggtatcgtgcccgatagggcagaaactggctatggttatatcaagtcaggcgcagtgctggaaggtttcggttctgctttcagtattgagcagtttgttgagaagcctgatgaggctactgctcagcaatatgtagtaagtgggaattatttctggaacagcggtctgttcatgatgcgtgccacggtatggctgaatgcgattgctaagactcgtccagatatcttatcttcatgtaagcaggcttgggatggtcaacaacgcgatggcgattttgttcgggtggacaagcttaaatttcaacaggtacctagcgattctatagactatgcggtgatggagcatgtcgctcgtggtgccgataatctgcctgcaggcatagtcatccccctgaatgccggctggtcagatgttggggcctgggattcattcgggaaaattttgccgcaggataacgcgggtaactcccatttaggagatgtgctgttcaatgattgctcgaatactctagctgtgtcttcaggtaggctgcttgcatgtgtgggtctgcaaaacatcgcggtgattgagacagcagatgcggtgctagttatagataaaagtaaaactcaggatgtgaaaaaaatcgtggagcagcttaaggtccagaaaaggcccgaggccaagactcaccgcaaggttcaccgcccctggggctggtatgacagtattgatatgggggcacggttccaagtaaaacgtattgtagtgaatccaggtgctacgttatctcttcaaatgcatcaccatagagccgagcactggattgtggtgaccggtacagcgaaggtaacaagaggagatgaggagttccttgtttctgaaaaccagtctacttatattcctttaggtgtgacgcatatgctggctaatccaggaaagcttcctttagaaatgatagaggttcagtctggggcttatttgggtgaagatgatattgttcgcttcaatgatcaatatggacgttcatga

SEQ ID NO: 108 - DNA, 921 bp, Methylobacillus flagellatus
atggcaactttcaacaagatcctgcttaccggcatcaacggccaggtaggccatgctctctatccgaaactacaaagcttgggagaagtcgttgcacttgaccgcagccaacttgacctatccaaacctgaccatatccgggacgtagtgcgacagaccaaaccagacctcataatcaaccctgcagcttatactgctgtggataaagcggaatctgagccggagctggcctacgccatcaatggcactgctcccggcattctggctgaagaagcagcaaagctaaatgcattgcttgtgcattattctacggattatgtatttgatggcaccaaaactaccccttacacagaattggatgaaacaaatccacttagcgtttatggagccagcaagttagcaggagaaaaagccattcaagaagtcggagcaaatcatctaatcttcaggaccagctgggtttatggtgcatatggaaaaaatttcatgcgcaccatattgagattagctgccgagcgtgactcattgaatatagtcgcagaccagtttggcgcaccaacttctaccgaaagcattgcagatgcaactattactgcgctgcacgcatgggatgggactcaaagaggtgtctatcacttagtcaatactggggagacgagctggcatggctttgcactggaaatcattcgccagtatggagaaatagcccaaaagaaaaatttagcgaaattaaaatccactgtagaaaatgttgtcggtattacaactgcagaataccccacaccagctcatcgccccgccaactccaagatgagcactgaaaaattcatgagcactttcaaaactgaattagcaccatgggaattggctttgcgatctacagtaacccacttagcaacattctcggtcgaaaatcattag

SEQ ID NO: 109 - DNA, 549 bp, Methylobacillus flagellatus
atgaatgtcacgcccacccatattcctgatgtgatcgtattcgaacccaagatattcggtgatgcccggggattcttttttgaaagcttcaatcagaaagcctttgaggaagccgtcggcaggaaatatgattttgtacaagacaaccactcaaaatcctcaaaaggagtattgagagggctacattatcagatccagcaagcccaaggaaaattggttagagtagtagcaggtgaagtttttgacgttgccgtggatatccgcaaatcttctccaacctttggtcaatgggtagggcaacatctgtcagcagaaaacaagaaacaaatgtgggtaccaccaggttttgcccacggcttcctcgtgctgtccgaaactgcagagtttctctataagaccacagacttctacgcgcctgcgcatgaacgttgcctaagctggaacgatcccgttgttggtattgaatggccagatattggcacgcccccgctcctctcaagtaaagatcaacaaggcttaggcctccaccagacagagttattcgcataa

SEQ ID NO: 110 - DNA, 879 bp, Methylobacillus flagellatus
atgagaaaaggcatcatcctcgccggtggatcgggcacccggctttaccctgtcacccaggcagtctccaagcaactgctgcccgtgtatgacaagcccatgatctactatcccttgtccacgctcatgctggctgggatacgcgacatcctcctgatctcaactccgcaggacacaccacgctttgaacagctattgggtgatggcagtcaatggggactcaatattgcctatgcagtacagccctccccagatggattggcccaagcctttatcatcggcaagaaatttattggcaatgatccaagtgccctggtgcttggcgacaacatcttctatggtcatgacctggcacatgacctggcacatgccgatcaacggcagcatggcgccactgtatttgcctaccctgttcacgaccctgaacgttatggcgtggtcgagttcaacgatgctggccaggctatcagcctggaagaaaagcccaaagagccaaaatcccgctatgccgttactggactgtatttctatgacaaccaggtcgttgacattgccgccagcctcaaaccatctcctcgaggcgaacttgaaattaccgatgtcaacaaaatttacctggaaaggcgctccctcaatgtggaattgatggggcgcggtcatgcctggttggatacaggaacgcatgaatccctgctagaagcctcactattcatcgaaaccatagaaaagcgacaaggcctgaaagtcgcctgccccgaagaaatcgcttaccgcaaaggttacatcgatgcagaacaagtagaaaaaattgcccagccatacctcaagaatggttacggccaatatttgatccggatgctgaaagaaaaggtcttttaa

SEQ ID NO: 111 - DNA, 1101 bp, Methylobacillus flagellatus
ttgacgacattaaataacactatcattgtcactggtggcgcaggcttcatcggtggcaacttcgtactcgactgggtcaaggcaggactaggcaccgtcatcaacctggacaaattgacctatgccggaaatcttgaaaacctggcagacattgaaggcaaccccaaccacatcttcgtacatggcgatattggtgaccgcgccttggtcgccaagttgctggcagaacacaaaccccgtgcagtcatcaactttgccgccgaaagccatgttgaccgttccatccatggcccggaagacttcattcagaccaatgtagtcggcaccttccacttactggaagaagtacgcgcctactggaatagcgtggtgaaaacccacccagaggaaaaagaaaatcctcagttccgcttcctgcacgtctctacagatgaggtgtatggcacactgggccccaaggaccaagcgtttacggaaaccaccccttacgcccccaatagtccatactcggcttccaaggcagcctcggatcatctagtgcgtgcctaccaccacacttatggcttgccggtattgaccaccaactgctccaataactatgggccttaccatttccctgaaaaattgattccactatgcctgctcaatgcgcttgctggtaaaccattgcctatttacggtgacggccagcaaatccgcgactggctattcgtcaaggatcattgcagcgccatccgccgcgtactggaagcaggccagctcggggaaacctacaatgtgggcggttggaacgaaaaggccaatctcgatgtagtacagaccttatgcagcatcctggatgaactcagccccaaggcagatggctcaagctacaaagaccaaatcacattcgtcaaggaccgtccaggccatgaccggcgctacgcaatcgatgcaagcaaactggagcgcgagttgggctggaagcctgcggaaaccttcgagtcaggcatcagaaaaaccgtggaatggtatctgcaaaaccaggcatgggtgcacaacgtcaccagtggagaataccgcaactgggtcagcaagcaatatagcgggagcgcagcatga

SEQ ID NO: 112 - DNA, 1005 bp, Methylobacillus flagellatus
atgttattagtaacaggcggtacaggctacataggttcccacgcatgtgtggaactgattaatgcgggctatgaggtggtggtgctggataatttcagcaatagccaggcgcatatcgttgaccgcatcaagcagatcacgggcaaggcacccgtattggtggaaggggatgtgcgggatgaagcactactgagtgatttattttctaggtacccattccaggcagtcatgcattttgccgggctcaaggcggtgggggagtcggtcgcgcagcctttgcgttattacgataacaatgtggcgggtagtgttaccttgctgcgcgtcatgcaggcgcatgacgtcaaacgattagtcttcagttcgtccgctactgtgtatggcgatccagccagtgtgccgattcgcgaggatttcccgttgtctgcgaccaatccttatggggcaagcaagctgatggtggaggatatcctgcgcgacttggcagtctccgatccagagtggcgtattgccatcctgcgttatttcaatcctgtgggcgcgcatgagagcggcctcattggtgagaacccgaatggtatgcccaataacctcatgccatacatcacccaggtagcccaggggcagcgtgaatctctttctgtgtttggcagtgactatccaaccgtggatggtacgggcgtgcgcgactacatccatgtggtcgacctggtggttggccatttgcgtgccctggagcggctggataaggaagctggtgtgttcacatgcaatcttggcacgggccaaggatatagcgtgctggaaatggtcaaggcatttgaagacgccagtggccaggctgttccctatcagctggtggcacgccggccgggtgatgtggcggccagttataccgatcctgcttatgccgagcaggcattgggttggaaagcgacgcgtggcatcgagcagatgtgcaaggatagttggcattggcagcaaaaccttgcccagagaggctga

SEQ ID NO: 113 - DNA, 1419 bp, Methylobacillus flagellatus
atgctgcttcctgtcattatgtctggcggggccggttccagattatggccggtttctcgtgaaactctaactaagccatttatcgaattacctgatggcagaacccttctgcagaagactttgcaacgtactgcttgcctggatggtgtgagcgaagtgctcacagtaacgaataaggaatattacttcctgacacgtgatgtctatgaggcaacagacactaatgtttcccatagctacttactagagacgatagggcgcaatactgctcctgccattgcagttgctgcactacatgccgctgcgaaacatggggaagatgtagtgctgttggtgatgccggcagatcatcttattggtaatcaaaaagttttttcaaaagcagtgactgttgcgacagatatggcggtgaatggctggatagtcacgtttggtgtagagccaagcacgcctgaaacaggttatggctacattgaaggcggagagtcaattggggactcaggcgcgcgtagagtcgttcgatttgtcgaaaagccagatttggaaactgctgagaaatatattgctttaggtcgatttacatggaatgcaggtatattctgttttactgcaaaaaccattattgctgcacttgcggagtatgttccagaagtgcttgagatagcaaaaaagaccctggcatctagtgactccaaaactgagcctgttgtattgggcgaggagcactttgcatcaagtccagatatttccatagattatgccgtcatggagcgtgcttcaaaagtggcggtagtcgcagctgattttgactggagcgacattggttcatggagcgccatggctgagttggtccagtcagatgagcgtgggaatagggtgaatggcgaagctttattggtggatgctaataattgctatatccaaagtgattcccgtcttgtggctggtataggtattgataacctgctggtggtcgatacacccgatgccctgcttgtggctcatcactccagagctcaggatgtcaaaaccgttgtgaagcaactcaagcttgagtcccatagtgcggcaaattaccatcgcaaggtacaccgtccatggggcacatacaccgtattggaagaaggcgctaattttaagatcaaatgcatcaaggtaaagcctggtgccagcctgagcttgcaaatgcaccatcatcgtagtgagcattgggttgtagtaagcggtatagctaaagttgtcaacggcgagcgcgagctgctcattaatgccaatgagtctacttacattccagcaggacacaaacaccgtcttgaaaatccaggtttgcttgacctggtgattattgaagttcaatccggggaatatttgggcgaagacgatattgttcgttttcaagatatctacggacgcacttga

SEQ ID NO: 114 - DNA, 795 bp, Methylobacillus flagellatus
atgatcagcatgttaaaagccttatggctttatcgcggctttgtgttgggcagcgtcaagcgcgagtttcaatccaagtaccgtaattcgctgctaggcgcagtctggacggtcttgaaccccctcgcaatgatcgtagtgtacacagtgattttctcgcaggtaatgaaggctcgtttgcctggcgtggacagtacttttgcgtttagcattcatttatgcgctggcatactcacctggggcttgtttgctgagattgtcgggcgctcacagaccacgttcatcgataatgccaacttgctcaagaaactgagtttcccccgtctatgtctgccagtcatcgtcaccgccaccgcgctagttaactttgccattgtttttgggttgttcacagcgttcttgctgctgatcggtatgttttcgggttggccttatttggtgctgatcccggtattgatactgatgatcgtctttgctctaggcttgggtattatattgggcgttctcaatgtgtttttccgcgatgtaggtcagttctttggcattgtgcttagtttctggttttggcttacgccgattgtctatccggtcagcattcttccagaacgggtacaagattatatgcggcttaaccccatggcgcgcttgatggaggctttccaaggaatattggtacaagcaaaatggccggactggtacagtctatggccagtgtttgcgctgtctatcgtgttgtgcctgctggggctgtctttattccgcaaacatgcgggcgatatggtggatgaactttaa

SEQ ID NO: 115 - DNA, 537 bp, Methylobacillus flagellatus
gtggattctgcaaggagtaagttttcatatccagccaggagagacggaggcagctttgccgtgactgctgccaagcgttctaatacgagtattaagcctaaccttgcagtgatcaattggatgcttgagcaagaagaccggatgggattatctaccccaaggccttatcgtgaatttgaggagcgtgtatatcgtcatcgcgatgatctcaggcgcttaattcattcgttagtagctgacggcaaaaaaatatatgggtatggagcttctgccaaaggtaatgtagtactacaattttgtggctttacttctgaggaaatccctgccattgcagaagtaaacgaagaaaaattcggacgagtcactccgggaacgcatattcccattatttcggaaaaagaggcgcgcgctgccaagcccgactacttcttggtgcttccatggcatttcaaagatggtatcctgcgccgtgaaaaggactttctagctgatggcggcaggtttatcttcccatttcctgagatcgaaatcgtctag

SEQ ID NO: 116 - DNA, 1041 bp, Methylobacillus flagellatus
atgaccataaaaactgccatcattaccggcatcacaggccaagatggtgcatatctcgcagaacttctccttagtaaaggctataaggtttacggtaccttccgccgtacaagctcggtcaacttctggcgtattgaagagctgggaattgaaaatgacccaaatcttcttttggttgaatacgacctgaccgatttgtcagcaagcatccgtctattgcagagcacaggtgcaacagaagtgtacaacttagctgcgcaaagttttgtgggcgtgtcttttgagcaacctattactaccgcggagatcacaggtgtcggtgcgctcaatcttttggaggccattcgtttagtaaatcccaatattcgctattaccaagcatccacatccgaaatgttcggcaaggtgcaggcgattccacaaacggaagatacgcctttctatccacgcagtccttatggtgtcgccaagctgtatgcgcactggatgactgttaactatcgtgaaagctatggaatcttcggatctagcggtattttattcaatcatgagagtccgttgcgtggtcgcgagttcgtgacgcgcaagatcacggattcggtggccaagatcaagctggggaaacttgattgcctggagttgggtaacttggatgcaaagcgtgattggggctatgccaaggattatgtggaaggcatgtggcgcatcctgcaggcggatgagccggatacctttgtactggcgaccaatcgtaccgagactgtgcgcgattttgtaagcatggcgttcaagggggctggcattgctgttgagttcaagggcaagggcgaggacgaagttgccgtggatactgcaaccggtaagatagtggttcgggtcaatccgaagttttaccgtccagcggaagtggacctactgatcggtagcccagccaaggccaaggccaagctgggttgggaaccgaagacaacgctggagcaactctgccagatgatggtcgaggccgatctgcgccgcaacacggaaggtttctcattttga

SEQ ID NO: 117 - DNA, 867 bp, Methylobacillus flagellatus
ttgagaattctgcttactggtgctgatggattcaccgggcgccattttctgacggccgcgaaagcggccggccatgaggttgttgcactgagggccgatttgacggacaaggctgtattgcaacgcgaagttgaggcggctcgtccggaagcagtggttcatctggcagcgatcagttttgttggtcatgcggatgttagtgccttttatgacgtcaatgtgatcggtaccctgaacctgttggatgcgctggctggcttgtccgtgacgccgcgcagcgtactgctggcaagcagtgcgaatgtgtatggcaatgcagcgcattcacctatcaccgaagagcaggcgccggcgccggtcaatcactatgcaatgagcaagctggccatggagcacatggcccgtacctatctggacagactgccgttgttttttgtgcggccgttcaattacacggggccggggcaggctgagtctttcgtgattcccaagctggtggcgcatttcgcgtgcaaggcgcagaccgtggaactgggcaatctggatgtggagcgcgagttcaatgatgtggctttcgtttgcgaggcctatctgcgtttgttggacaaggctgtgccgggtgaggtgtttaatatctgcagcggtgctccggtgacattgcgtgcagtaatcgggatgttgagggaattgacggcgcatgatatcgaggtcaaggtaaatccgcagttcgtgcggaataacgagatcaagacattatgcggtgatccatcaaagctgttccgtactattggagaggggaggctggttcctttagcgcttaccttgaagatcatgctggaacacgctacgcgaaaagaaaaaaaatga

SEQ ID NO: 118 - DNA, 1143 bp, Methylobacillus flagellatus
atgatgaaggtaggttttggtgtcaccgtgcttacacgttgcctggcattggggggaatcgatggaattggtagttatacccgggagctgatgaaaagactcgaggctgacccggccgtcgagcttttccctatctcgtacgggtattctccgtcacagtttcctatcggctcacgtgctccgacgacatttggacgatatgcgccgcttgctgcagtatcggctgtatccgggtttccctttctgggaacagctcaattgaaggagcgtgttgatctgattcatgcgcctgatcatcttattcccaactacggaaaagttcctgttattgcatccatcatggacgcgattcccttgtcgcatccggagtgggtatcccccaagttgcgcaagatgaaaaatgcgttatggaagcgctctgcgcactgggcatcgcatatcattactatctctgagtattcgaagcaggaaatttcacagcatttcggtattgaggcacaaaagatcagtgccatcccgcttggcgtggatgagcggtggtttcagccgttggaagaagaggcgatgaaggtggtattgagacggtacaatctgcctcaatactattttcttgtcgtggggacgctgcagccaaggaagaatgtcggccgggtaatcgaggcatatcggtccttgccccaagggatacgtaacgaagtgccgttggtgattgttggtagggcagggtggcgatgcgaggatgtggttgaaatgttgacttcgtcttcttcaggaaattctctgaggtggctcaagcatttgccggatgccgacttgcttgcagtgttgaaaggtgcaacggctttggtctttccttcgttgtatgagggatttggtttgcccgtagtcgaagcttttgcggctggaactcccgttattacttccaataccacttctcttccagaggtggcgggcgatgccgccatgctggtgaatcctctgaatgtcagcgacattgccgctgcaatgcaatcgatgctggaacagccggaactggcagagagtttcaggaacaaggggcaagaacgcgcattggcatattcgtgggacaaaacagcctccatgacgcttgacgtctataaaaagacgcgagaggctgcttaa

SEQ ID NO: 119 - DNA, 1200 bp, Methylobacillus flagellatus
atgatcatccgttttctgggcgcacagtggctcgccgttggttttgtcggggtcatctctctggcggtcagcattttgattgcgcggacgcttgggccggattcatttggtgtttattcggttgtcttgtccggcggagccattgccgccattctgcttgatggtggtttcgggcgattgttgcaaagagaacgcgcccatcccacacctgcattgctcagattcctgcccatattgccgcaggctgccttggggcatgtgattatcgcggccagcatattttcgttgatcgctttattggtactgcccaagcatgcgctgacgattgttgcggttatctggtttttcgcagcatctgtgaccaatcagttcggtttgaacattctccgcggagatgggcggatggtaagggatgcctcgtggcagatgggcaatcgaaccttcacagctgcgtgcgtgtgcattgtcattctgatgggagctgagaaaccgtggcaggtattctttgcccagtttgtcggtgcgaccgccttcggtttgctgatcatgcactatctgcgcacgcgcccgctatggaagattcctcctactctttatgcggcaaccttgccattcgtgtggttggatctcgcgacagtcctttattttcgagcggacatgctgttgctggaatggttagatgtgtccaagtttgaagtcgggaaatacggggttgcctgccgcttgattgaggcggtgattctgcttgcttcgccgctctgtattattttgttccgcaagtttcgtctgggtagcgcttctccccgactgatgttgcggagaatgctgccggtgctggcaggggcgctgatggttggagtgttcttcatggtgtttttctggttgtgcagcacgcctttgatcgcggttgcatatggcgaggcctatgcgggagctgatcatattctggcgatactcggctgcgctttgctttttattttgccaaatggcgtgctgaaccaagctgcgctagcgctgggtatcgaacgttggctggcaatgtcggcatcttttgccgcagtgctaaatattgcaggaaatctctggctgattccccaatatgggttgattggagctgcctggatgactgttgtgaccgaagcggtgttaggctgctgcgttgcgttagggctatggcgccaccgtaataggagtgtttaa

SEQ ID NO: 120 - DNA, 1134 bp, Methylobacillus flagellatus
atgcaggatcttgccgttgctcatgtttatcgtacctattttcctgaccctccaggcgggttgcaggaggcaattcgccagattgccctcacgacgggtatgcagggcgtcgataatacggtgtttacgctttctccgcagccgcgtccggcaatcttgcagcgtccggaggcttgtgttgttcgttgccgctcctgggcggctccggcatcatgcgatctgggcggtatcggcgcatttcttgcgttttccaggttggcggaaaaatctgatgtgctacattacctttttccgtggccatttgcggatgttctgcatacggtggttcgcccaggttgtccggccgtcatgacttatatctcggacgtggtgcgtcagcagcttttagggaggttatatgctcctttgatgtggaaggtgttgcgccagatgaggcttgtggtggcgaattctccagcgtatgcacgcaccagtcccgttctctcccatcctgagattcgcgaaaaagtcagggttattccacttggtattgaggagtcttcttatcctaaatcaggggatgaggagattctgcagcgtctaggcattgggaaggatgagccttattttctttttattggcgttcttcgttattacaaaggcgcgcattttctggtcaaggcagcaaagcggataggcgcaaaggtggtgtttgctggcgcggggccggaaggcgcgcgcctgaaagcattggctggcgaagtcggtgcagagaatgtgatttttgccgggatggtgactaacgcggaaaaagtaaccttgcttcaatgctgcagagcgcttgtgttgccatcgcatttgcggtctgaagcgtacggcatggtgctggtagaggctgccatgttcgggaagccgctgatttcttgcgaaattggcacaggcacttcatatgtcaaccatcatgaagaaacagggtttgtcgttgagccggcctctcctgaagcattggcgtcggcgatggcggttttgttatcagaggataggctggctacagagatgggagctgctgctcgtcagcggtatgagctgctcttttccggcccggcattaggaaaggcatatgctgcattgttccgcgaagttgacgcttcgtag

SEQ ID NO: 121 - DNA, 942 bp, Methylobacillus flagellatus
atgatgcaattactggtgacaggcgctacagggtttgtaggtaaaactttgtgcagtgcgctaaggcggcagagcttccccgtaaaagcaattgggcgtgcgggcactatccgggctgacgctttgggtgatcaggttgcttcaattgacggtcaaacggattggtcactgatattggacggcatcaatgccgtcatccatctggcagccagggtgcacgtcatgcgggaacagcttgctgatcccttggcggcatatcgtgaaacgaatgtcgaagggacgctgaatctggcgcgtcaggcggcaaaggccggagttaagcggtttgtattcattagttccatcaaggtcaacggcgaacagactctacctggaaagccttttactgcgtacgatgtaccagctcccgaagatgcgtacggtatttcaaagttcgaggcagagcagggtttgctggccctggcgcgggagacagggatggatgtggtggttattcgccctcctttggtttacgggcctggagtgaagggtaattttgccagtatgatgaagttggtgaaaagtggaataccgttgcctctgggcgccattcataaccaacggtctttggtggcgattgataatttggtgaacctcatcgtcacgtgtattgaccatcccgcggcagccaaccaggtttttttggtaagcgatggcgaggatttgtccacttcagatttgttgcggcgtttggccaaggctgcgggcgtttcctcccgattgatgccagtgtctgcccgctggctagagatgggtttgcgtatgtgtggcaagcgattgatcgcccagcgtctcctgggatcattgcaagtcgatatttccaagacgcgcgagttgttggggtgggttccgccgatctcagtggatgagggcttgaagcgctgtttctctaccaagggctga

SEQ ID NO: 122 - DNA, 552 bp, Methylobacillus flagellatus
ttgatccgattttttgacattattttttcggtgataggcttggtactgggattcccgctattgctatcgatttataccctcggcttgtttgatacaggtgctcccttgtttcgccaggtgagggttgggcgctaccggcagccgtttactttggtgaaatttcggacgatgaaggtggatacggcttctgtggcgagccatctggcttccaccaattccatcacccggctcggacggttcttgcgcaggaccaagctggatgagctgccccagctctggaatgtcctgaagggagaaatgagcctggtggggcctcgaccgaacctgttcaatcaggaggagctgatggccgagcgcgagttgcgtggcgtttaccatgcgcggccagggattaccggccttgcacaggtgaatgatatagacatgtcgacgccaaggctgcttgccgagaccgatgccaggatgctgcgcgagatgaatgtacggctttatttcaagttgctgattcagacggtgctgggtcgaggacagggcgaccgggtcgtgcgctga

SEQ ID NO: 123 - DNA, 1914 bp, Methylobacillus flagellatus
gtgctgcattatttcccctcattcaagtggtcgaactacatcagtttgaagaatccacgctctttgagcgcttggatatatgacattgttgctgctgcgctggcatggtgggcagccttcctgttacggttcaattttgatattccggccaattttgtccagagtatgctcgacagcgcagcatgggtgattccgctgcaggcatttgtgtttctgctggctgggttgtacaaaggcgtctggcgttttgccagcctgccggatttgcagcgcttggtgcgcgcgattgcgatcagcgcagtgcttgtggttgcgatcttgttcatgttcaagccacacggcattgttcctcgctcggtgctgatcttggatcctatgctgttgctgctgttgatgggcggcagccgctttgcttaccgagcatggaaagaacatcgcctgtatggttctgcccagttttccggaaagccggtgctggtgctcggcgcgggtgaggcagcgattgccttgttgaaggatctttccaaaagccgtgaatggcatgtcgttgggttgctggacgataagaaaaccatgcatggccgagagctactgggcgtcaatgtgctggggtcgattgcgcaattgccacagatcgctgcggatttgtcggtcaatcatgtgattgtggccatgccatccgcgcgtcatcaacgacgcagggaaatcgtcgagctggcaagcagaaatgggctgactgcgctcacggtgccgtcgtttgatgacctgatgagtggccacctgagcatggcacagattcggccggtcgaggtggaggacttgctggggcgggagccggtcagtctcgatggagaggggctccagcatttgatcgaggggcaggtgttgctgattactggtgcaggtggttccatcggttctgagttatgccgccaggtgctgaaataccgtccagcttgcctggtctgcctggatcagtcggagtacgcgttgtatcggttggagcaggagtttgacaatctggagtttgatacccgcattgaatacgtggttggcgatgtcaggaacgcacgccgggtggggcaggtgcttggccgttatatgcccaaactggtgttccatgctgctgcgtataagcatgtgcctttgatggagaaccgcaatgtggcggaatcattgtcaaataatgtcagcggtacttacacgctcgcccaggcatgcaaaactgcaggggttgccaagttcgtgctgatttccaccgataaggcggttaatcccaccaatgtgatgggggccagcaagcgcctggcggaaatgatatgccaaggcctgcaggaggagtcgggtacgcgttttatcgtggtgcgctttggcaatgtgctgggcagtagtggcagtgtaatccccaagttccgtgagcagattgcggcgggcgggccaattaccgttacccatcccgagatcactcgctatttcatgtccatcccggaggcgtgccagctggtcatgcaggctggattgatgggtggtggcggggagatatttgtgctggatatgggagaccctgtgcggattgtggacttggcccgtgatatgatccggttatccgggcttaatgaagatgacattcagattgtatactctggcttgcggcccggcgaaaagctgtacgaggaacttttggctgacgacgagctcactgtaccaacaccccacgacaagctacgtattgccgtggcgcgaagcgtggatggtgcttgggttcaggcattgctgaaatggatcgacagggcatcgctcatagatgaatctgtcatcaagcaagagctgggcatgtgggtggaggagtatgcaggggatattcatgccaatccatccatgatgttcccccccgagtcttcaaccatacattag

SEQ ID NO: 124 - DNA, 876 bp, Methylobacillus flagellatus
atggcaaaaaaaattaccaaggcagtatttccagtggcaggtttagggacacgtttcctgccagcaaccaaggcgagtcccaaggaaatgttgccaattgtggataagcctctgattcagtatgcagcagaggaggctgtggccgccggtgctaccgagctgatttttattatcgggcgcaacaagcgcaccatcccggatcattttgataagtccttcgagctggaagcgacgcttgaggcaagcaagaaaaccaaggtgctggaagaaatccgcaatatcctgccaaaaaatgtttcctgcatctatattcgccaggccgaggcgcttggtttggggcatgcggtattgcttgccaagtccgtggtcggcagcgagcctttctctgtgatcctggccgatgaccttattgatgccgacaaacctgccatgcagcagatgacagagctgttcgaccaagagggtgtcagcattctgggtgtcgaggatgtggagcccagtgagacggcaagctatggcattgtggatgcgacagaggtgagtggcccgaatgtgttgcaattgaatggcattgtggaaaaaccgcagccggaagaagcgccctccaatctggctgttgtcggtcggtatattctcacgcctgaaatttttgaatgcctggagaacgtcaagccgggcaagggcggggaaatccagttgactgatggcattgccgccttgatggaaaaacagaaaatcctggcttaccgtttcgatgggaagcgctacgattgcggcagcaagctgggttatgtcaaggcgaacgtcgagtattccttgaagcatgaggagtttggcaaagagtttgcccagtacttacgtgatctaaccaagtag

SEQ ID NO: 125 - DNA, 819 bp, Methylobacillus glycogenes
ttgctacaacaattttctatcggggttagagagcaccatcacaaggagctcactccagaccaggctggcgctttcctggaggtggttgacgcatcattgcgtatcaagaaaaaggcccagttcttttcctggctacaaggttattttcaattcctgctaccgcatgaagtactactctgtggtctgtccataggcgcaggacgtcccttcacgctggaaaccttcagcagcacgcgctatgtcaccgatacccatacggccgtgagcatgcaggaaactgatggtgtggtgttgcgtgcgattcagtcctggcaggaaaccagcctgcctgtgttggttgatccttatctacgtcccggcagtttcggtaatttcacggtgccggagatagatcaggccaatctacaggccagcgagctacgcaatctggcagcttatggtctgtcttctgccgatggcagcatttcctctttcttctgtttttcacgcgtggccggggagttgaatggcaaccatgcctatctgctggaattgctggtgccttatctgcactcggtgctgatgcgcgttagcgacagtgctacggcttctgccgatatgttgggcgatagctcggtggcggggctgatcaccatgcgcgaaaaggaaatcctgcattgggtacacacgggcaagagtaactgggaaattgccaccatcctgcagatcagccctttgacggtaaaaaaccatatgcagaatattttgcgcaagctggatgtgcaaaatcgcagtcatgcggcctccaaggccttcaggctgggactgattcgtaactaa

SEQ ID NO: 126 - DNA, 1140 bp, Methylobacillus glycogenes
gtgggttattccgaccctgtgctggctcgtgaaggtgatgtcatacggccctatgtcagtgcaacatatgtttatgatgacaacctgaggcgccgctctgacaaggagtccgatacgagtgtagtgggccgggttggcattattctggataaggatattagtcagcagaatttctacgccaatatcggtgtgaatgaaaccaaatacaacaaaaattcagagttagacaatacaggtaaagatattgtcgctcgatggaactgggcagtgggctcgcaattccggggcaaggttgagtactataaaaacgaggctatgctgccttttgcggattttcgtggtgtggaattgaatatgcgtattcaggagcgtaaaacttttgaagcaaactggcgtttccattccagttggcgcgcgcgctttggtgtgcagcgccaggatgttgagtatgactctcaaacattgaatgcggcttcttttcaggaaaattcccagcacgtaggtttggactatttagctgagtcaggcagtaaggttggcttggtcttcactaatgggcgtggcacgcggccctttgataggcctgcttttttcccggggattggtaccgtgtttgtcaataatgactacaggcagcaatcactcaaggcggacatactttggctttattctgccaaaacacgatttgaatttttgggggggtatgttgatcgtaaacatgacagcttctcacagcgcgatttttccggatttaatgcccacgggaacatggtgtggtccattaccgacaaaacctctttcaagacagccgcatggcgcgatgcaaatgctatatcaatcgtaactgccagctatgtgattgatagtggcgcaagtgcaagcatctcctatagcgcaacgagtaagatcctgctgtcaacttcagccaggtatcaacaactaaaatttgaaggcgatatcaccgggcaagatcaaggtcgtaccgacaagaataaggttttttcttttggggtaacgtacagccctcttgaatcgttaagtttcactactggtctaaatagaagtttgcgtgactcaacctcaccaattttaaactacaactcgacaagcatttcgcttactggtcgttatgaattctga

SEQ ID NO: 127 - DNA, 1384 bp, Methylobacillus glycogenes
atgaccgtaaatgacatccctttagtagcgtttttcaagcagctgctcgacccgctgatcattcttggtacgctgtatgtgttcaccctgttgtttggtgagccttttaatggctactacctgattctggcgttgctagcctactttgtttcctctaatgtctacgagcgtctggatctttaccgtacctggcgtagtggcaagatacttggttatatccgcgatattctctttggctggggtattgtcatcgctgtgctgatgttcatcggctatgccgctgatctatccagtcagtatctggatgagatgatatatgcctggtttgccagtgtgccgatgatatttattgtcacgcatctggcgatacgcaaaattgcctcggatttgcacaagaatggtgaagtcaggtccgtagtgattatcggtgccaatgatattggcgtgcgcttgatcaatcgcatcacggacgacccgtacctgtttatggaggtcaaggggatctttgacgacagagaggtcgccaggcaccccaagggcatgcgtaatctgcctttgcttggttccatgtcggaaattgcgccatatgtccgcgccaataatacccagattattttcatcagcctgcccatgtcggcgcagccacgcatcaggcagttatttgaagaattgcaagacaccacagcatctatttactttgtgccggatatctatatttttgatctggtacaagcgcgctttgatgatgtggctggtgtgcctgtggtcgctattcttgagacgccattcaccggtttcaacagtttaatcaaacggactagtgacattattttggcgtcgcttattctattaatgctgtctcccatcatgctgacactggctctggccgtgaagttgacctccccaggcccggtgattttcaagcagcgacgttatgctgaatggtgaggaaatcattgtctataaattccgctccatgaaagtaatggaagatggtgacaaggtagtacaggcgcagaagcgagatcagcgattgacaccgattggtggtttcttgcgcaagaactcactggatgagctgccgcagttcatcaatgtgttgcaaggtcagatgagtatcgtggggcctagaccgcatgccgtttctcataatgagcaatatcgcaagctgattcgtggctatatgctgcggcacaaggtcaagcctggaataacaggctgggcgcaggtgaatggtttacgtggtgaaactgataccttggacaagatggagtcccgtatcgagtatgacttggattatttgcgccattggtccctggcttttgacttctggattatcgtcaggacggtgctggttgtgttcaaaaaagataacgcctactag

SEQ ID NO: 128 - DNA, 933 bp, Methylobacillus glycogenes
gtgaataacggatttgtaactaacttcaagcaatccagaaccctgtgtgtcggtgctgtgattgtgctcgctttcgcattgtcgggctgtggcgacaagcatgaatccaaagccagccagtctctggttaaggtcaatggcaaggaaatcaccgtacatcagctgaatcaggagctgggtcgtgccaacattcaggagaatcagcgcgagcaggcaacgcagcagattctgactgcattgatagatcgccagttacttgaagaagctgcgctcaaggccaaggtggatagggatccaaatgtgatgaccacgattgaacgtgcgaaatcacaaatcattgctcaggcatatctgcaatccaagttaggcagtgtcgccaagccaagcaaaacagaaattgagaatttttataacgagaatcctcaattcttcagcaagcgcagaatggtggaaatggatcaattgttgattgatactaaattcgccaatgatgaattgaaaacagcacttggcaaactcaagaccttgcaggaagtagccgcatggatggatgcccataatattcagtacgatcaaggtcaggtttcacgcagtgttgctgaattgccgccacagatttccgagcgcctcaaggccgaggataagggtaagttgttcgtgatcggcatgggccctcgcaccatgttgatcatgatgaacgagatcaaggacagcccagtttcacttgcagaagcaacaccgcaaattgaaaacaatttgctgaataaggcgcgcaaggaagttgctgaaaatgaagtcaagcgcttgaaagccgatgccaagattgagtacatcgataaaaagatggaaacagcgactgaaaccaaggcagccaaaaagaagccaagctctactgaggatgatatcgccagtggtgttagtggcttgaaataa

SEQ ID NO: 129 - DNA, 795 bp, Methylobacillus glycogenes
atgaaaaaattaatgacatggtttttcttgctgatgctgagtctgacgccttttgtaacgcatgctgcagaaggtgacattcttctcggcgctggcgatgtgctgaaaatatcggtgttcgagcagcctgatctgtcacttgaggtcagagtgagtgaatcaggttccattacttatcccctgataggtgaagtgcgtgtgggtggtggtacggttgccgccgccgagcaaagaattgccaccatgctggaaaagggtggtttccttaagagtgctcacgtcaacatcatcgttgcgcaattgcagagccttcaagtctctattctgggtcaagtcaatcgcccgggcagataccctatagatagcgctaaaacgctggcggatgtgcttgccttggctggtggtgtatcacctgaaggtggcgatctgatcacgctggtgcataacgtcgatggtaaagcggtcagggatcagattgaccttgctgacatgatgcgtactggcgatctcagcaagaacatccgcgtagctggtggtgacatcatttatgttgaacgtttcgataaattctatatctatggtcaggttcaacgtgccagccattaccgtctcgaacatgaaatgacagtattgcaagcgctttctgtaggtggtggcttaagccctcgcggcacagaaaaaggcgtcaagatcaagcgtcgtgatgctagcggccatattgaagtaatcactgccaaacatgatgacctcatcaagcccaacgatgtgatctatgtgcaggaaagtttcttttaa

SEQ ID NO: 130 - DNA, 1389 bp, Methylobacillus glycogenes
atgagcttttctcaacttttactgatattcaaagcgcgatataagatattgttaagcaccattgttgtggccctggtcgtagcaattgcgctcaatattttcttgccaaacagctataaggcaaccaccagtatcctagtcaactataaaggtgtagatcctgtgactggtatggctgtccctgcccagctgcttccaggttatatgggtacccaggtggatatcataactagcaagaaaattgctaagagggttgtgaccacattaaagctcaatgaaagtagtgaggttgtggagagtttcaatgactccacaggtggtgaaggtgatatcgttgattggttggcggatttgctgatctcacgtatcgaagttcaacctgcgcgcaacagtagtgtgttgcagctggagtttgatggagccaaccccaaatttgctgctgttgttgctaactcctttgccgaggaatatatcaaggccactatcgaactcaaggttgagccttcgaaaaaggcggctgaattttataccgggcaattgaaggatttgcgtgccgatattacccgggcgcagcaaaagctttccgattaccaacaagataaaagcatcgtcagcgttgatgagcgtctagacattgaacgtgccaagctgaatgaactttcctcgcagttagtgatgtcacaagggcaaactcttgaggcacagtctcgtcagactggtgcacaaggtagcaatgcttatggatctccggatgtcgcgagtaatccaatggttctgcacctgaaaacagagattgctaggtctgaatcacgcttcgcggatatctcacaaaaatatgagagaaatcacccactctatcagggggccaaagctgagcttgacaatctgaagtctgaattaagtaagcaaatccaggcggctaccgtcaatatatcgagcaattatagaatccttaagcaacgcgagagtgaaatccgcaatgccttggctgagcaaaaaaccaaggtcatgctgttgaacaaggatagggatgcactgacggtattgacgcgtgaagtcgagggtgcgcaacgcgcttacgaactcgcgactcagcgatatactcaaataaatcttgagggacagtctaatcaagctgatgtatccatccttaatccagcgacaccaccacttaagccatcaagcccgaaaaaaatattgaacgtggcagttgcgttggtgctgggtacaatttttggcttgttgtttagtttgttggctgagctcactaatgagcgaattcgctcagaaagagtgctggtagagattgttggcgcaccgctgctgggtgtgatcgacaaaaataaaacccattccagaattcagcgcctgctggctaaaaaaccctaa

SEQ ID NO: 131 - DNA, 879 bp, Methylobacillus glycogenes
atgactaatgatgtttccaatactagttccattccggcattgaatgctgatttcaatatcggtggaatgttgctcaagatgggtaagattacaccgcaggatgcggagcgtatcctgcgtgtgcagaaggaaagaggcgttcgctttggtgaggctgccgagagtttgggcctagtttcctctgccgatatcaactatgtattatccaagcagtttgcctatccctacctgatggatggtcgcggcgatttctccgagaacttggtcgcggcttatgatccattcagtatcaatgtggagaagtatcgcgccattcgtagccagctcatgctctactggtttgcacaagggaaaaagagcctgtcattttccagtgtttacgacaaggacgacaccagtgacttggttgccaatcttggcgtggttttctctcaactgggagagaaaacactcatcattgatgcccatcttgatagcccacggcagaatcgcatttttaatatcaagagcactgcgggtttgtcggatattctggcaggccgggttacggattactcctcttccatcactaggctagtcgagttcgagcatctctccatcttgtcttctggcaccattccacctaatccgcgagagcttctgggacgtggtttcctcaagcagttcatcacggcaattgctaatgactacgatgttatcctggtcgatgcaccttcctttgtccgccactctgaaccgttgtctgtggcaagtgctacggaaggggtggtgcttcttgccaagcgtcatgtctccaaagccaatgacttgagcaaagtggttgatcagctttccaagatcagggtgcctgttgttggcacggtattgactgaaaactaa

SEQ ID NO: 132 - DNA, 900 bp, Methylobacillus glycogenes
atgagcttgaaccagagcattgcggtcgccagtacccagctaagaaggtaccagcatgtgataccactgctggtaggcttgctgttcttatttgtgcccacctacctgaacctgacgaacacggtctggcagatgcaggatcaggcgcatggccccttgatcctgatggtggtgctgtacctagtctgggtggacaaggaaatactgctagacacggcaaacttgagacaaagcgggcgtggtgtgggcctgttgctgtttttgtttggcctgttggtatacatcatcgggcgttcacaagatttgctggtgtttgatgtgggctcgcagattccggtattggctggcttgctgttgattttctataaggccaaaaccctcaagcgcttctggttccccttgttcttcttgttcttcatgattccattgccaggctccatgctggatgttgtgaccttgccgatgaaggtcgctgtctcttacgtggccgagcatgtgctgtattggtttgattaccccatcgcgcgttcgggtgtgatcattcagattggtcagtatcagttgctggtggcggatgcttgtgcaggcatgcataccttgatttcactggaggccctgggcctgctctacctcaatatcgtcaggcatgattccctggcccgtaacttgttgctggccttgctgattatccctatttccttctcagcgaatgtcatacgcgtgattgtgttgaccttgatcacctactatttcggggatgaagtgggccagggctttgtacatggattcgcgggtattttgttatttgtcgtggcattaaccctgattatttcagtggatagcctgatccaatactttgttggcaaacatacacagcgtaaggctagattgcagagttga

SEQ ID NO: 133 - DNA, 687 bp, Methylobacillus glycogenes
atgagcgtcagattaatcaatatcctggcagtatgcatggtggtgagttctggcctggcgttggctttgacccctgatcttagctccgtgcgggatgatccacatcttgaaagtttcgtgcctagcagctttggtcagtggcaggaagtcaaaaccaatcaggtgcagatggacctgacagtcaggagagatggcgaacccagcatcgataacccttatgatgaagttctcatgaggagttatgccaatgaaaagggtcaggtcattatgctggctcttgcctatggcaaattgcagcggcaggaagtcaaggtgcataggcctgaactgtgctatacggcgcagggtttctccatcagaaatcagcaggataccgcagtgaatgtgggggcaggcgcaacacccatcccatccaaggcgttggttgcggcttcaagacagcgcgaagagctggtgctttactggatcaggataggcgatatgatcagtaagagtgcttgggagacccgactttatattgtggagcaaggcctcaaacatcaactggtagatgggatactggtcagaacctcacagatattgggtgaagatgatgccgagcaatctttgcagctacaacaacagttcctgcacgatctggtgcaagcagtgcccagggacaagcgtaaatacttgattccatcataa

SEQ ID NO: 134 - DNA, 1137 bp, Methylobacillus glycogenes
ttgaagatattatttctaagtcacactgccgcagggggcgaatttgtagttggctcacatcaactatctaaacaattcgccttgcaagggcatgaggttgtccacctcagtccgccagtgacaccagcacatctgacactgttgcagaaaacaccgtttgagcgtgtccggtttaagcgctggatgaaagcgggtgatgtcatcaaccacgtgaccgacattattcctttctcattaataccttggggtattgccacccgcttgggatctggtagcgatatctttggttacttcctgaagttttcagcactcagacaactccgtaaacatcaattttctaatcctgacgtagtgttgattgatgagcctcgattaggctatctactcaaatatttccctaagtcaaagatcgtataccgccccactgatatttatcatgaaatcagaaatgatcccagtattgtagatgctgaaaaagggttgatatcccaggtacacggcttcattgcgacatcagagcctgtaagacagcatttgaatcgcctaggtgttgatgaggtgctattgctgcagaatggtgtagatctagatcattacctgaattttacaaaatccaaactggatttgccgcctgagccaagggcaatttatgctggagctctggatcatcgctttggttttgatgtgctgaaaagtgcagccacaaaacaccagaaaatttcatttttattggctgggccagtagaggaaaaatacaaggcggcatttagtgatcttgccaacgtacactttcttggtcatgtgcaatataaagcgttgcccaatctcttgagtcagtgccaaattggtttattgccgatgtctgatcatccatccaaccttggccgtagtcctatgaaattgtttgaatatgcagcagtcggacttcccgttgtttctacctcaacaccagagcttgagcgcagatcattaccctttgtatttttggctgagaatgcccagattttcacagataaacttggtgatgtttgcaatgcggatatcaaaatattggctcagcaggctcgagataatgctaagcatgagtcttgggcaagtaaaaccatcacaatactgaactatatttattcaaagtaa

SEQ ID NO: 135 - DNA, 1263 bp, Methylobacillus glycogenes
atgaacaaaactactgaaccacaagatagtcaaaccaatgttccatggtggctatcccctcatggactatgcttaggctttcttttgcctatgatcttgttgatctggtggttggggtcagtgagatcaccaacattaaccatacggggttatatatatttaagttctgaatatatagctctggctgtgctaattgttgtgctgtcagcaagtgcagcctggatgggaagcttcgtcaagacaaaagtcagagtgccgccagactctcaggttaatatggctttgcgggtattaggctatgtagcagttgcagcatatatatactggttcaaagagctgattatcaatcctatgaatattattaatatatttacagggacaggtttatcaagacaggaaattggtgcaacgcaagggattacatcacttgttaacttcaccccaatatttatttcgatttacatatatgccagatatatcgccaaattacctttaagacaagatgttgtattgttgttctatgcaattgttttattgacattgctgcgggtatttgcctgggcagagcgtctggcattaattgaaattattttgccatttgcgttattgataacgcggcaacaagtgttcagtaagattaaaattttgcaattcttcattaaggctggtcccttcgcgggattgcccttgctggtgctttactttggtatggcggaatacttccgctcttggagctctacaacttacgccgggaaatcgagtttttgggattttgctctagggcggattgcttcatattattacacctcgctcaataatggtgcgggaatgctggctactgttaactggccaacatatgaattcgaaaatgtgttgaattggatgcataaatttccaatttttggcggcgtgtttcgttactacgtagatttgcacactatgagaatgggtgagtttctcgctcagtatggtgatgaggagttcaacaacccttctgggatattttcagtgatcctggatttgggcttgccatttggcattatctacttctttataaccgcatttcttgcaggaatcttttataaaggctatttgagaggcaattttttaagtgtaattttttatccgttattttttattacgttattggaaattttcagatatccgtatttaggaacgtcccgagcttttaccgagattattggtgtgattattgctttctttatagttaagggaaggactgaaaatgatagaaaatcgtag

SEQ ID NO: 136 - DNA, 1365 bp, Methylobacillus glycogenes
atgatagaaaatcgtagacacctggttaaatcattattcttgatgctattttcatcctggcttcccaaggtcgcctcggcagcgcctaaggtggtcgggggcaatgcagacttcactagagctttagatgacgcgcttgctggacgcacggaagtgctaagcggttattatgaaataagtaatcctttaagattttcactgaagagtggcaccgtaaaatttgcaccagattttcagctgaaattcttgaatgataaattaagtggtttagtattttcgagttgcagtgatttatcactcattggtggagatttttcgtacaaaaaccccccagctagaagaattggacatggtggtatttacgagttctctagatgtaccaaagtcatcgttagagatggattttattatgacacaccaggtacaggtatcatttttaccttatgtgatgattgtgcagtaattaaagctacggtttggaattcctgggctgatgggttgcactttgcaaattgcaataactgcatcgccttggattatcagtctaccaatacaggggatgatgggttggcgtttgtaaactacaaaaaacatcccgatgcagtaggtggttatgcgaacaacattgttatcaatggttcttatgcacgaggaattgcgattatcggtcaatctggtgtgactatagacaagtttgaaattaggcacacttccgcagaaggattaaagattggaagtgagcaatactatgacactagaattccttccaatgtgacaatcaaaaacggcattgttgaagaggcaggtacttggtgcgtggcaaaggcaactggcaatggtttcctagtccaaggtgctaccgataaaattgttgttgagaatttgactgtcaatgccccacgcgtgcatggaattgttttcgacaggcatggcggtaatgtcaaaatgaaagatatcgtcgtcaagaatacaaaagcaagtggcataaccatgatggcggataacatcgagttagtgaatggggagtttttaaatattggaacaacacctctttacgtcaataaagcattaactgctaatttctccaagattaatgtcaataccttcggattcgcagataaatcaagttggcctattttctgggctgttgaagctaagaatgtgttaattaaccaaatgaaagtggagtccaccaccttggttagaattggtgggaaaaacgttatttcacatcagataactggggtgcagatcagtggtgtgcagcttagcggactgctctctgatgggcttaattccaaaacaacatcggcggtttctgctataacatcaactgctgttaagtttattgagcagtggaattag

SEQ ID NO: 137 - DNA, 1107 bp, Methylobacillus glycogenes
gtggatgcaggtgcgagattgaggatttcatggatcgatgtctgccgtggatttgcaatgctgttggttgtggttgggcataatcagatattaatgggccaaagtctttctttggtaaaatttatttatctttttcatatgccactgttcttttttattagtggtataaccctcaagccagatcaaggattaacgtactatttcacgcgggcgattaatgttattgcggtatattttgtattttcatttttagttcttccttttgttttaatgaaaaatccagatgatggtgttttcaatatagttcttggtattttgtacggaactggacatacaatagaagttgctcctctctggtttataccatgtttatttttctctattgttttggtcggtctcgcattagttatttcaaatcattttaataacactgatcgtgaatcaaatagaagtccgatttttttccttgcattattgtttatcggagttggtgtttttctcattaactcaattcattattatttaattgataatcttgcttggggtagtctgaaaaattcaggaatgatttggagtattgatatagcaataattggtgctggctttattcttctaggtatgtacgcaaaggtatttgttgataagtacaaaattactgaaatcaaatcaatatatcttattgtatctattgtttgtgcgattttcgttatgttggggttgtttagttttggtgttgacgtcgatttgaattttagaaaaattgcgcattatcctttggctatgctctgcatgatcttaggaatatttttcagtattttgttttcaatttttctagataaatatacctacctatcaactatcttgagcagtattggtaaatctacgttattgattcttttatttcacaatgcgattcaaaatcatttaattttcacaattggtgattcaaaaatatatagtgctgtgatcggcattgttatcgcaatattgatacctatagtacttgataagtttgttgtgaataaatacgaattgttcagaaaaatagtttacccaaaactatctatcaaccttgcatccaagataatggtagggaaaagattttga

SEQ ID NO: 138 - DNA, 1098 bp, Methylobacillus glycogenes
ttgattgtatatattaatggccgatttttaggaagacgcataactggggttgatcgatacgcaatagaagtattaaaagagttaaatacactgattgcggaaaatcatcccagtgtagctggtgttgaatataagattgttattcctcctcgcatcaaaactgacttgcatctaactcatatacctatagtggcttatggtttttttagtgggcatgcgtgggagcaattgtccctactaatgttgagtctgagtagtaagtcaatggtattaaatttatgtaatacaggctcaatcttcgtgcgtagtcaaatcgtcgtcattcacgatgctgcagtggtgagaattcctagtacattttctttagcatttcgggtgtggtacaaaacactcatgccagtactcggcagagtcgcaaagaaaattgtaacggtttcagaatattcgaaaaaagacattattaacttttttggtgtacatcctgaaaaagttcaagttgttggtgcaggcggcgagcatattttgtcgcaacagccagacgcaggtattcttgaaaaatttcaagttcacccgggctcttatgtgttggcggttagtagtcatgctccgcacaaaaatttttctttaaccattgaatctttaaaactttctaagaatgcaaatattccgtatttgattgcaggtggggctaatcagaaaatttttggtgaaaattcccagttagattcttctaaggtgacgttgctgggttatgtctcggataatgagttgcgcgcgctttatgaacatgcgctttgttttgtttttccatcactttatgagggcttcggtcttcctccactggaggcgatgaattgcggctgccccgtacttgcatcaaatgctgcatcaattccagaggtgtgcagtgatgctgcattatatttttcaccgcatgatccgcaggagctttcaaagcttatagataatgttgctcatgatgccgatttgagaaagtcgttagtcaaccaaggcttgaagcgagcaaaagatttttcttggaaaaattccgcaatagatattgcacggatgtgcaaggagattttcacaataaagtaa

SEQ ID NO: 139 - DNA, 1155 bp, Methylobacillus glycogenes
atgactaataaatatacgaggcattcgagattgcacccaaaaaaagtagctatcgttgtggattggcttaatgaatatgctggagcagagcgtgttctggagcagttggttctttgctatcctgatgcagacatttttgctgtcattgaattcttacctgataacctgagaggttttattcagaataagaaggttacgacaacttttatccaaaacttgcctaaagctaaaacgcattatcgcaattatttgccactaatgcctttagctattgagcagctcgatctgtctcaatatgatttgattatttctagttctcacgccgtggccaagggtgtgcttactgggccagatcaagtgcatgtaagttatgtccattctcccatgagatatgcgtgggatttgcaacatcaatacttgcgtgagtctaatttggtttcaggttttaaatcttggattgtcaaatggttgctacataaattgcgtatttgggatctaagaacggcgaacggggtagatgtttttatcgcaaactcttcttttattgctaaaagaataaagaaggtatatggacgtgaggctagggttatttatcctcctgtagataccaacagttttgcattccaggaaaagaaagatgactttttcttgactgcctcgagattggtaccttacaaacgagttgacttgattgtggaagccttttccaaaatcccagatcagaaattagttgtcattggggatggtccagacatgtccaaggtgcgtgcaaaagcagggccaaatgttgaaatcctcggttatcagtctcatgctgtgttaagagactacatgcagcgtgcgaaagggtttgtcttcgcggcggaggaagattttggtatttctcctgttgaggcacaagcatgtggtactcccgtgattgctttcgccaaaggtggcgccttggagacagttattccagaagagcgaggtgatcctgccactggtttgttcttccatgagcagacagctgatgccatcgtggatgctattactagatttaatctactctctcaaaagattagtccatttgcatgcagagagaacgcactgcgcttttctcctgatcgatttagaaatgagattatttcaactgtgaataaggctctcgattaa

SEQ ID NO: 140 - DNA, 1167 bp, Methylobacillus glycogenes
atgaaaatagctgttgcaggtactgggtatgtgggcttgtcgattgctgtgcttttagcacagaaaaatgaagttgttgctcttgatatcgtccctgataaagttgaccttatcaacaataaaatttctccaatcgttgataaagagattgagcattatcttaagaatattccattgaacctacgtgcgactacaaacaagcatgatgcatatgaaaatgcagattttgtagtgattgcaacccctacggactatgatccggttaccagctacttcaatacctcctctgtagaggcagtgatcaaggatgtccaggcgattgcgcccaacgcgaccatggtgatcaaatccaccatccctgttggttataccaaaatgatttccgaaaagttgggtgtggataacctgattttctctcctgaattcttgcgtgaaggtaaggcactttacgacaacctgtatccctcgcgtatcgtcattggtgaaatttcggatcgcgcacaagtttttgccgaccttctcaatgcaggtgctgtgaaagagaatattccggtgctattgaccaatagtgctgaagcggaggccattaagctgtttgccaacaccttcctcgccatgcgcgtcgcctatttcaatgagctggatacttatgccgccacccatggcctgaacacacgtcagatcatagatggggtgtgcctagacccacgtgtcggtgaccactataacaatccatcgtttggctatggtggttactgcctgcctaaggataccaagcaactgctggccaattacgacaacgtgccgcaaaaactcatcaatgccattgttgatgccaacaccacgcgcaaggatttcatcgcccagagcatcatcaagcgtgaccccaaggtggtgggtatctaccgcctgatcatgaaagcaggctcggataacttccgcgccagttcaatccagggcgtgatgaagcgcatcaaggcacgtggtattaaggtcgtggtgtttgagcctgagttgaaagaagatcaattcttcaattcagaggtgatccgcaatctggaagagttcaagaagatttcagacgtcattgtcgccaatagaagggcgcaggatttgtcagacgttgatgagaaagtatatacgcgtgatttgtttggcaatgactag

SEQ ID NO: 141 - DNA, 972 bp, Methylobacillus glycogenes
atgaggatacttttttcacctgctacggcgagtaatcagtatgtcgagaacacgattgccctgattaaaaccctagacgctacccatgtcgaaacccaagccagattgaatgctggattcatcttgcgcaatgctttcaaccgctatgattgcattatcatcaactggctggaaaacaacctggttggaaaaaacaagtcgcttgatatatgggcggtagcaaaatttctgttcaagtttttcatctacagagtcatggggagaaagttgatttttgtcaggcacaatatttatcctcatgccttgaagggtcggcaggcatccatcgcgacctggatcattgaagcggcgattaagctctcaacaatatccgttgtacattcagggcatctcgaaaatgagaacgcgaaatatgtacctcatcctttgtacagggttgattcgcaggttgaaggccaaggcagtgattattatgtaatttttggcaggattgttgcgtataaagccatccataaattactcgaaagctgggggtcgcagcggctaatcatagccggcattgtcgaggatcatgcctacgctgccagcttgcaatccatcatacagtccagagggttgagcaatgttgaactgcgtgctgaattcctctccgaagccgaggctgaacaactggtagctaacagcaagggcttgattctttcacattgcgatgccgacatgattgtcagtggtagttttttctttgctgcaagtctgggcgtgcctgtttttgccatggatactccatttttccagtggctgaagaatgagcaaggctatcagggcttgcaggtgttcacatcactgcaggcaatgacggctgagctagccactgccgcggccgtggaaaaaaatactattgctgcttcagcccagcgtttatttggcaatgatagggtgagaagtgcatggggtagtgtgctccatggttaa

SEQ ID NO: 142 - DNA, 1413 bp, Methylobacillus glycogenes
atgaccacgataggtcaggatgttaaccagcctgcaggcattcctgaagtatttacaatcaatgatgtcgttgacagagggctatgcgttggatgtggtgcgtgcgcggttgtagattcaaacgtcaagctaacgcgcaatcaatatggttccatggtggccgccattgatgccaatatcctgccagggtctattgccgaccgggtatgcccattttctgataacagtcttaatgaagatgttgtgggagaacgggtttttgcgagttgtgaaaattttgatcaacgtaccggttattacaccaatttatattatggccgcaggttcactgaagctgaattgctgaaaagcagttctggtgggctgaccagttatgtcgccattgaacttctcaagcgtcatcacgtggatggcattattcatgtgggacgcgaccagtcagatgatcgcgatgctttgttcaagttcatggtgtcttacacagaagaagacgccaatgcctgcaagaaatcacaatattattccctgagttttgatgaggtagtaagaagcatacgcggagatggtaagcgttatgtatttgtgggcgtgccctgctttgtcaaatctctgagaaatatttgtctcaatgatgctgtgctcaatgagcagattccattcatgctgggcttggtgtgtggtcatttgaagtcttcgcgctttgccgaattactagcgtggcaacttagtgtgccaccggaaaaaatccagagtgtggactttagagtaaaaaataatgcctccaccgtgaattcctacgatttccaggtggtggatagcaatcagcaagcccatgcaaaaacctctaatacaatgctgggcggcaattggggccatgcggcgtttcaacttcaggcatgcgattattgtgatgatatatttgccgagacagcagacgctgtctttggtgatgcatggttgccgcagttctccacatggtggcaaggtaccaatatcgtcctggtaagaaaccctatcatcgacgacattctggaatcggggaaaaatgcaggcgccatcactctgggcggtgtcagcattgatgatttatgcaagtcgcagttgggtaatttccgccacagaaaagatggtttgattgtcaggttagacgatgacctgaagcagggcaagaaggtccccaaaaaacgggttgatctgtctgcattaggcaagattgaccagaagagaaagaaaattgtcaggctcagaaaggaaatggccgtgaaaagtcacgaatatttcctgcaggcccgagaaaagcacgatctcagcctttatatgaagcccatggggcagttggcgagaaatatgcttaagctgtatagggatccatttatgaagcgactgatcaataggctgaagcgatatttttaa

SEQ ID NO: 143 - DNA, 1449 bp, Methylobacillus glycogenes
ttgagtctatctgtaaaagccgcgcgcggtggtgtggtcatgatgtcaggacaaattgtgaaggtagctttgcagtttggcagcctgattatcttggcacgcctgttgcaaccagaagattttggtttggttgccatggtgattgcgatttatggcatttgcgacatcttgctcgactttggcctttcgacggcgtctattcaagtccaaaacataactaaagcgcagatcagcaacctgttctgggtcaatgtattgataggtctgttgtttacgctgatttcatacttttcagcaagtttactggcgagcttttatgctcagccagaattaaccaaaattgcgcagtatgtttctgtggtgtttttattcaatggtattgccgcacaatataaagcccagctgaaccgtaatttcaaattcaaacagatggcaataacagatacgactgctgttttgctcagtgtttgtatcggggtctatttcgcatatgccggacattcttactgggccatcgtatatcagcagatagcgcaggcattgatacaaatgcttttgtacatgcttttcggcgcttggctaccttccttgccttcaagacatgtttctatcagacatttcttcaaattcggttgggggctggctggttctcaattgatgggatacttctcgcgcaatattccagctatcttgattggtaatcaaataggtgccagccagttggggttttacgatagagccaacaaattactgatgttgccgctaaaccagctgaatgcgccttcatcgtcggttgctgtccctgtgttgtcacgtttggcagtggaagatcaggaaaaatacaatcgttttcttctgtttggacaaaatatcattgtccatctcgttgtattttgcctggccttaacctgctgccagacagagcgcctggtgcaattggtgctcgggacacaatggttggaaatggtgccggtctaccgggcactttcatttgcagggatatttttggcgctcagctatgccagttactgggtatttttatctaaagggattactgcctctctatttaaactaggcttggttagcaggccaatctctattttgattatttgcctggggctgcccgctggtgtgattggcgtagcgtatgcatactcggcaagtctgctctttacctggctactcggcgttttctggctgaggaaaacgggcgttcctgtcaaaagcatgattgtagatccactcatcatgtctgccatttactatagcgccagttttatcgccaattacgtggtcgatcattatgtggactttgccatatacaacattcttgtcggctggttgctgatgttgctgatcctggcagtattttatttgttggtccccaagttcaaacgtagcgtgaaaaagttatttgaagtgaaaagttatattcggaacaaacaatga

SEQ ID NO: 144 - DNA, 1206 bp, Methylobacillus glycogenes
atgaagaccattaaaaaattactatacaaaatcctaggtagtgcaggcatcaaggccaaggctgcagcagtcatcaatctcctgtttggtcgtgtggctagaagcactaatgacagtgtctctattcttattccggcaccaggaggggggaatatcggtgatcaggcaatgctggaatcatttttgcataatattgatggcaaaaaactcattatcaaaacacagcctatagcattggatattcctagtcactatgcagtgaacgttgaagtgatcgaaatgccaggattgatctacggtcatttgttcaggtttttgcgggattacgtaagactgagaaaaataatggcatctgccagcgctttgtatgtagttggcgcagatatcatggatggtggctataataaaaatgcctctatcatgcgctctaaaattgcaacttatttcgcgcgtaataatattccatccagggtgtttggtttcagttggaatggcaatcctgatgcagcagcgctttctgctatcagaaacgcagctgccaatggggttttgctttgtgcgcgagatcctctttcattccagcgtctacaagatgcaggggttcccaatatcaggctggttgcagatatggtgtttgccaatgacaacaccaaatcagctgggattgaagatattttgcaattctgcgcaggcaagcagattgctctggtaaatgccagtggattgattggcaaaaatattgatcaaattgatgaatatagcaaggtaataaacaagctgatggaccacaattttaatattgtactattgcctcacgtgatcagacacggagccaatgacttgccgatttgtcaggcattgtcaggcaagtatccgaatgctttcctagtaaatagactgttggaaccagatcaggttaagcgcttagcacaagaggctaaaattgtcgtcaccggtcgcatgcatctttccatcatgagcctgaatcagaatgttccatctatcgtattatcgacccaaggcaaggttgatgggcttatgcaattcttcgaaactgaaaaactgtcgattaatccggaaaaaggtttttccgatcttatttgttcacaaattgattttatttgttctaatcggcaatattatcaagacctgattcgtaaaaacctacttaaggttaaggaactggccgctgggaattttaattag

SEQ ID NO: 145 - DNA, 1188 bp, Methylobacillus glycogenes
atgtctaaattctataaatttcaggtgttagaatcactaagaggttatatggcatggtgggttgttttaggtcatgctatccaactttctggtttttggcacaagcaagaagtagatgagttttttacaggagggggcataattaatgccactttttcaaaaatactcagtttaatcatcaatccagaacttgcagtcaacatttttattattttaagtggttttgtgattactcatttattgcttactaaaaatgagccatattcacatttcataactagacgatttttccgcttggcgcccgcattttacgtttcgttagttatcgcgattttggtagttaatttttacaaggttgcatataccggtctgagtttttctggtgatacctcgatgcgactcgccaggcttgttgagcaagatagtaattttttattgcatttattcaatcatttactcctcattcatagcgttttcccgcaagagctgattcaattttcacctaccacgtttcttgctccggcatggagcatcagtcttgagtggcagttctatctaattgcaccagtcttaattccatttttggtgaagtctgagaagtctttgattgtttgggttgtgttgttgctactgctgcgatattttaccaaccatgttttagactttaattggcaacatagctccttcttctttaaagctgtcgattatttcttggtcggcatcttaagcagattaattatcgagcgactgcagcatggcaagtttatttatgatgttgccgtgttgctaggtggaatattgcttttccaggatagatattgcgctgttatctggctgtttgttttggctgtcatattttatgaaatgggttattggagtgttaaatctcccctatggaaaaaaatcctgacattatttttctacaataaagtcatcacgaatattggtaagtggtcttattctacttacctaatccatattcctattttctcaattttcttaggtggttatgcaactctgactgaccctggcactgtaacccagcaaatttctttgattatcctatttgtcagttttccagtggttttgctgatttcaaatattatgtatcacaacatagagctgccatcgatgaattatatttccgcaaaactaaaagaaaaacgtatcactgaatctgcagagtga

SEQ ID NO: 146 - DNA, 1407 bp, Methylobacillus glycogenes
atgaaaattgttcctgtattactctccggtggttctggtacacggttatggccactttctcgagcggtattacctaagcaactgttgcccttgatcactaataaaaccatgctgcaggagacccttctcagaatttcaagatgggcgactgtaacaaatccagttgttgtttgcggtaacgatcatcgattcttagtggctgaacagttgcgcgaaatcgctttgagtcctaactctattattctagagcctgcccccaagaatactgcaccagctattgccgctgcagcattgcagctacaaggtcaggatgtttatatgctggtcttgcctgctgatcatgtcatcagggatctgcaaagttttgaacatgctgtgcaaaccgcattgactgccgctgatcaaggtaacttagtcaccttcggtatcaaacctgctcatcctgaaaccggttatggctacatcaaattaggcgttgagagcgcaccaggatcttataaggtcaatcgttttgttgagaagccagatcttgccacagcaactgaatatgtggcgtcaggtgagtttttctggaacagtggcatgtttttattcaagccagaaactttcctcaagcaactggaaatccatgcccccgaaattactgctgcagtaagcaaggccgtcaataacagttataaggatctggatttcgtcagattagaagaatcgagttttgctgagtctccgtccttatccatcgattatgcggtaatggaaaaaaccgatcatgctgttgtagtgcctgctgatattggttggagtgacgttggctcatggacgtctctacaagaggtgcaagagcaggatgccaatggcaatgtagctcgtggcgatgtttacctcaagaatgtcgagaacagtctggtgcggagtgaggataggtttgttgccgcgattggtgtccgtgatctgatcgtggtggagaccagtgatgccgttctggtagctagcaaggatgctgcacaagatgtcaaggaggtagtggaatacctcaagttaaatcaacgctctgagcacaagatacatccacgggcctacaggccttggggttggtatgaaagtattgatctgggcgagcgccaccaggtgaaacgtatcatggtgaagccgggcgaaaagctgtccctgcaaatgcaccaccatcgtgccgagcattgggttgtagtcagtggttcagccatgattacggtggatgggaataccaagctattcagtgaaaatcagtcaacgtacattccaattggctccacccatagattggagaatccgggcaagttgccgctgcacttgatcgaggttcagtccggaagttatctgggcgaagatgacattgtgcgttacgaggatacctacggccggtcctga

SEQ ID NO: 147 - DNA, 333 bp, Methylobacillus glycogenes
atgcttacggatgaataccgatacaagattctgaaattggtgcaggaaaaaccagatatcagccaaagagaactggcgaaagcactaggcattagcttggggaaaaccaatttttgtctcaaagccttagcgcaagttggcttgctcaaagtatctaattttcgcaacagcaagaataagttggcatatatgtatgtcctcacgccgacaggcatagaacataaagctgctgtgacactcaactttctcaaactcaagctcaaagagtacgaacaattagcaggagagattgaagagttacgtagtgagatcaacgctaaggtaaatgattaa

SEQ ID NO: 148 - DNA, 1089 bp, Methylobacillus glycogenes
atgttaaaaaaagtagctctaattacaggtatcactggacaagacggagcatatctagctgaatttttacttggcaaaggctatgtagtacatggcattaagcgccgagcatcacttttcaatacagatcgcattgatcatctgtatcaggaccctcacgtcgataaccagaatttcatccttcattatggggatttgacagattccaccaaccttatacgtatcattcagcaggttcagcccgacgaaatctataacctcgcggcaatgagccacgtggcagtcagttttgaaagtcctgaatatacggctaacgcggatggtcttgggactttgcgtattctggaagctatccgcatcttggggctggaaaagaaaacccgcttttaccaagcctcgacctcagagctttatggtttggtgcaggaaacaccgcagaaagaaagcaccccattttatccacgcagcccgtatgcggttgcgaagctttatgcatattggattactgtcaattaccgcgaagcttatggcatctacgcctgtaatggtattttattcaatcacgagagccccttgcgtggggagacctttgttacccgtaaaattacccgtgccttggcgcgcatcaagctgggcttgcaagattgcctttatttgggaaatctggacgcgttgcgtgattggggtcacgccaaggattatgttgaaatgcaatggctgatgttgcaacaggaacaggcagaggatttcgtcattgcgacaggtgtgcaatacagtgtgcgcgatttcgtcaatgcagccgcccacgagctggatattgccatcacctggaaaggtcagggccaagaagagatgggatacgacggtcaaggcaggtgcattgtacaggttgacccgcgctattttaggcctaccgaagttgaaacattgcttggtgacccgagcaaggcaaagcaaaaacttggctggtcgcccagcatcagtttccaggagttggtttctgaaatggtgcgtgaagatctcaagagcgcagagcgtgacgaactggttaagcagcatggttttgctgcctatgactataacgagtaa

SEQ ID NO: 149 - DNA, 974 bp, Methylobacillus glycogenes
atggacaaacacgcacgtatctatgtggcagggcatcgaggcctagtgggttccgctatcgttagggggctagagggcaagggctatagcaatcttatcaagcgtacccatgcagagcttgacctcacagatgctaatgccacggaagcattctttgctcagtatcagccgaatatgttttcctggcggcagccaaagtgggtggcatagtggccaataacacttacccggcagattttatccgtgacaatctcgcaattcagaacagtgtgatccatagtgcctggaagcatggagtaaagcgcctattgtttttagggtccagctgcatataccccaagcatgctcctcagcccatgcatgagcaccactttctaaccggatcgcttgaagctaccaatcgtgcatacgcgctggcaaagattgctggagtcgaaatgtgctggagttataaccggcagtatggcactcgatttcttgcagcaatgccgacaaatctttatgggcctggcgataactatcacttgcagaatagtcacgttatccctgcattgatacgcaaattccacgaggctaaacaagctgggcatgcagctgtatcggtctggggtactggaacacccaggcgcgaatttctttacagtgaggatatggcagatgcctgtatattcttgctgaatctgcctgaggagaaattcaattctctgctgggaagtgatgagagtgctactggtgtgtttgatccaccactagtcaatatcggtattggagtcgatatttcaatacaggaattggccgaattggtaaaaaaggtggttggttaccaaggagcaattgagttcgatagttcaaaacctgatggcacgatgcgtaagcttatggatgtaagcaagctcaacagtttggggtggacttattccattgagcttgatgatggattggaaaagacatattcggaatttttaacaaaataa

SEQ ID NO: 150 - DNA, 696 bp, Methylobacillus glycogenes
ttgaaaaaaaaagtgtttgctttgattcctgccagagcaggttctaaaggagtgccaaaaaaaaacctgaaaaatatcgcaggttctccattaatagcttacacaattaacgctgctaaaaaagctaaaaatgtcgatgctgtttatgtatcttctgattgtaaagaaatattggagtattcaaaagcacaaggctgcagttcaatattaaggccgcaagaatacgcaacagatgatgcgtcagctgttgatgttgtcaagcattttattagtattgaaaatatagaggatggagatttaatcgtttacttacagccaacctccccattaagagatgaacatcatattgatgatgctttgacggctttgaataataatggccttacttctttggtcagtgtggaagtcttggataagtcgccatataagtcatttcgtctagatgataatgataaattgatttcattatttgatgaaaaattatctaattatcgtcgtcaagatttgccattatgttacgcgccaaatggtgctatttatatcttttcgaaatttgaatttgaggctagaggcggtttcccctccaatggtagtgttgcttatattatgtctgctgaagaaagtgttgatattgacaccgaagaagattttttagaaacagaagcattattaaggaaaaaatatggcatcttttga

SEQ ID NO: 151 - DNA, 1041 bp, Methylobacillus glycogenes
atggcatcttttgaaatttctgggcggaaaattggggacggacatgagcctatagttattgcagaaattggcatcaatcacgagggttcattagatcttgcgattgatatggcaaaagctgcaattgatgctggggcagagataataaaacatcagacacatgtggttgaagatgaaatgtctgatgaagccaagagtgttattcctggaaatgcggatgtttcaatctatgagattatgcaacgttgctcattgtcagaggatgatgaatataagctcatgcaatatgtgcagcagcaaggcagtatttttattagtacgccattctcgagaatggcagcaaatcgactgagaaaatttgatataccggcttataaaattggatctggcgagtgcaataattatcctctcgtgcggcatattgcttcatttgggaaacctattattgttagtaccggtatgaatagcattgaaagcattgcaccaaccgtcaatatattaaggcaagcaaaagttccttttgctcttctgcactgcacgaatatttaccctacccctcctgagcttgtaagacttgatgctatccaagtcattaaaaatgcatatcctgatgcggttgtgggactttcagatcacacccttgggaattacgcttgcctaggggctgttgcactaggagcctcaattcttgagcggcattttactgactccatgtcacggccgggaccagacattgtttgttcaatggaccctgcagcattgcaagatttaatcactggttcaaaagttattttttcagcaaaaggtgcacataaaggtccacttttagaagaagaaaaaactatagcttttgcttttgcatctgtcgttgcaattaaggatatcaatgttggtgatgtcttaagtgaagataatatttggttacgtaggccaggtggcggtgattttaatgcttctgactatgatcagctacttggtcgtaaagcatcgcaaactatactgagtggcaaaagagttaatcggcaggatattgaggcatga

SEQ ID NO: 152 - DNA, 1132 bp, Methylobacillus glycogenes
atgagtaggcgagttgtttttcttactggaacaagagcagattttggaaaactgaaatccctcatgcgagcattacaaaatgacatgggatttgacgtccatgtgttcattactggcatgcatatgttgtcgaaatatggttatacatgtgaagaagtagaaaaagccggatttaaaaacctatttcgctttatcaatcaaaatcaaagcgatagcatggatcatattctggccaaaacaattactggtttatcagattatgtaaaagaaatttcaccagaactgattgtgattcatggggatagagttgaagcgttggccggagccgctgttggcgcattaaataacattcgagtggcacatattgagggcggagaggtctctggcactgttgacgagttgattagacatgcggtgaccaagctgtcccatgggcattttgtttccaacgaacaggcaaaaaatcgacttattcagcttggagaaagtgaagaatccatttttgttattggctccccagatattgatgttatgaattcaacatcgctgccaagcattgatgatgtgagggaacgttatggcttctcgttcgaacattacggcattttgatgtatcaccccgttacctctgagttagatgatttgccaagacaagccaaagccatcgtagattatatttcagaaagctctctaccattcattgttgtatatcccaataatgatcatggttcagacattattttgaatgagtatttgcgattgaaaaacttgagccacgttagagtttatccatccattagatttgaatattttttaacgctgctaaaaaaatgcagcgttcatcatgggtaactctagcgctggagtaagagaggctcctcatttcggcgtgccagccatcaatgttggtagcaggcaacacaatagagcaacagcagagtcgattcttaatactactgcacatgtggattcccttagacatgctgttcaacaagttgcagacattcctcgcgtggcagtttctgactttggtaatggtaatagtgcaggtgagtttcatcagattctgttgaataatgctttttgggataagggcatacaaaagcactttatcgataggagtgcagtgtga

SEQ ID NO: 153 - DNA, 738 bp, Methylobacillus glycogenes
gtgaggttgatcgcaaggctagatgtcaaaaatgaacatgtgattaaaggcatacacctagagggcttgcggaaagttggcgatccaatcgagatggcgaaaaactattatgcacaaggcattgatgagattgtgtttatagatgcggtagcgagcttgtataaccgtaataacctgctgtctgtaatcgccaaggcttcggaagaagtttttgttcctatcactgtagggggggggctgcgttccttagcagatgtcgagatggctctgagtgccggagcagacaaagtggcagtgaatacagctgcaatacttaacccgaaattcatcacagagattgccaagcgctatggcagtcaatgtgtggttgcctctattcaagccaaacggataggcaatgactgggaagcttatatggaagccgggagggagcctacgggcaaaaatgttgttgcttggagcaaggagctggaagatcttggtgcaggcgagattttgctaacgtctatagaccaagatggtacaaaaaaaggatttgaccttccattgcttggtgcagttaacacgatagtgaacattccagtcatggttagtggtggctgcggtaatcctgatcatgtgcaagagttaaaagaaatccagccaagtggagtttgtctggcgtcagtattgcattacaaaatcaatacgatagatgaattcaaacagcgtctgacattcatcaatggtactaaataa

SEQ ID NO: 154 - DNA, 639 bp, Methylobacillus glycogenes
atgaagaaaatatgtattcttgattatgggctaggcaatgtgcgtagtgtgagtaatgcgatcaagtacgtaggtgctcatcctgtaatctcaaatacgccagaggcacttaaagattctcacgcgttaatagtgccaggggttggtgcgtttgctcaaggcatgtctgcattgggtaaagatggattacaagctagcttgctcgaatatataaaaagtggaaaacatgtcttggggatttgtttgggcatgcaattgcttttcgacaggggtgaggagtttggcgttaccactggtcttggacttgtgcctggcgtagtctccagaattgtacccgtagagcaatcacgagtgaggttaccgcatatatcctgggcgaaagttgatctcaattccgttcatgaaaataatggcggcatgtttgatggactgccagacgagcagcgtaagttctattttctgcacagttatgccgctcaaaatgtacctgatcgatacatcacaggcagcgcgacgtattctggatgtacttttgttgcatcagtgcagaaagacaatatctggggtatgcaatttcacccagaaaaaagtgggcccagcgggttacaggttcttaataactttgtacaaaacagttaa

SEQ ID NO: 155 - DNA, 1227 bp, Methylobacillus glycogenes
ttgaaaagaagtgtggaggaagttgtggttaatgcatattttggtttgccggaagatgtagtgttttgcaagaaatgcgtgatttccaaccaaagacccagttctacagttgaattcaagcataccaacaaggacaaaaaagcgaccataggatttggcgctgatggtatttgtgatgcttgccgctatgcagaaaccaaggatgctcaaatagactggcaggcccgcgaggacgctttggttagattgttggatcaacatcgccgtagcgatggtggatatgacattgtcgtgcccggcagtggtggtaaagacagtgcatatacctcacatatccttaaatataaatatggtatgaatcctttaacagtgacgtgggcgccgcataagtacactgagattggttggaagaattttgaaaactggatccataaaggtggattagacaatattctttttaccccaaatggcaagttgcaccgctatttaacaaaaatggcatttctgaatttattgcacccattccaaccattcattgttggccaacgcattatcgggccgttgatggctaaaaagtttggtatcaaattggtaatgtatggtgaaaatcaagctgaatatggcaataagacagaagaaaactataaaccgacaatggacaagaattttttctctatttcagacccagctgacatggtgttaggtggtgtgaaggttggagacattattaaagacggtgaatacagcttaaatgatttcgcgccatatattccgcctgctgcagaagatctagagcgcgatggtatcgaggtacattatttgggctattacctgaaatgggatccacaagagtgctattactatgcagtcgagcatactggtttccaggcaaatacggaacgcactgaaggaacctactccaagtacagtagtatcgatgatcgaatagatatgttccactactttactaccttgatcaaattcggcattggtagggcaacatatgatgctgcgcaagaaattcgcaacgataaaattacgcgagaagaaggggttgctctagttcataaatatgatcaagagtttccaaaaaagtactttgcagaattccttgaatatatagagatcaccgaagcacagttttgggaaaccgtagataggtttagatctccacatttgtgggaaaagcaagacagtaattggatactgaagcatcaggtgacctaa

SEQ ID NO: 156 - DNA, 1194 bp, Methylobacillus glycogenes
ttggatactgaagcatcaggtgacctaagaatgaaagtgttgcagataggaagtttctccggaaatgtcggtgacattgccaaccattatggttttcgcaattggtttcaaggactgcttggagagattcaatgggatgaattcgaaatacgcaatgtttaccgaaaaaatgttgcctttgacgataattttgtagctattgcaaatcagtacgatcttatagtcgtgggaggtggtaattttttcgagctatgggttgattcttctccaaccggcacctcaatctcaattgagattgaggtttttaaaaaaataaaagtccccatctttttcaatgcattgggtgttgatgatggtatgggatgtagtgatgaaagtcttgcaaagtttactaatttcttagaaatcttaacttcatcaaagcaatatttggtcagtgttcgtaatgatggagcaatgggcacgctcagaaatcggatttctaataatcccatgttggataaagtcttaccattgcctgacggtgggttttttgtaaatctggataagttagaaaaagacattgcggaaaatgatcatgaaaacactcagatcaccatcggcatcaatctggctggagatatgttggaaacaaggtttccaggtggaattaatggatatgattactcaggatttatatccgagttcaccgagactttggctgaaatgtggaataaaaataaattaataaagtttattttttttccacatatttatagtgatcttaaagtatatgccgacatactatcacggttgcctgatgcatgtagacgtgaaaatgtcaaagtggccagttacgatactaatgtgaattttcaagggacattattttccgaatatagcaaatgtactttgatacttggtatgcgatttcatgccaatgttgtagccatagctaataaaattccagtaataggattgtactcatacaagcaaattaaagaattgttttatgagttgggaataaaagaaaaaattgttgatgtcagacaaataggttttaaaaatgaattgttgagaaagtgcaatattgttattgaaaattcatctatatctcgtgatgagagctgtaacatacttgatgttgtcacaaaaaaacgtgatttgattgctccaagggtagtggagtggttacgtgagcataagcttaaatga

SEQ ID NO: 157 - DNA, 1068 bp, Methylobacillus glycogenes
atgattaaaagccttgattatctaagggcgattgcagcactaacggtttttctcagccacacctttcaaatttattggttaccaaccattggattggtgtcctggaaatatgagttgaatcattttttgagtgaaaccgcggtcctcttattttttgtattaagtggctatgtaatttcgaatagtttgcatagcaatactcaacgtaatggagggcgtctttcagtacttgattacgcatctagcagattattgcgcatatatcctcctctcattgtaagcataataatatctttagttgcctatagtgtgattgtgatctttgaactaccgggatcagtgggtactttaaaggcaccaggagatatctatcaggcaagagactacttgagcattggtacgcgagacattgtcaattctttattgatgaataatggcttgttgcaaatgaatgggccattatggagtttatgcattgaggctaagctatatttttatgcttgtttagttgtaataatttttattcattataaacaaaaaaatttgctcaattttattgctaatactggttttctcgtattatctgtattcttgttttttaatacaaaaaccgatatttattatggcttatggtggttgagcggtggtgtaattttcttatatcgtcgaaatttcataaagttcatgactttggttgttgtaatggctattgtggtgtttgctatggcagtgattggacagaagttcgtttctttgccagtgcaagttatatttgtatattctttatttttggcagcaataaaatgcaaagtgccagaaattaaggcaatgaatattttggccaatacttcgtacactttatatattgtccatttccctatgttgttactatcgtacgccatcttctcatataactttgatgtgtacggtagcctgactagagagttgatgtcatcattatcgctaataatcatcttaactatgtcaatttatattggaaaatgggtagagcgtccagctaatttacgtttgacctatcacaggttgttgagaaaagtaaaagtatga

SEQ ID NO: 158 - DNA, 1680 bp, Methylobacillus glycogenes
atgaaagccatgttttattctttgcatgcagctatttggttacatgcgcttcctgaaagccggttggcatcacagctgagtaatgccggccatgagttagtatatgtgacctgtgataaaagctttactcattattgcactggtatgagtgctttcaatcttgcattgaatgaggattttaaaaagaaaagtgcaatttgtgagttatgtattaataacgccaataaaataaccaagtcttttgattgcaagcatcttaaattgcatgattatattgatcagaaaactaatgctctgattgataacctattgaaaagtgtcacggaagataatttcctcgaatttcattatgaagatataccagtagggcgtttggctacatatgagccacttcttaagtataagaaaatgtctttggaatttagagatgaacaatggcaagatctacagattcaccttaggaatgccctggtatcgttaatcggttttatccaaatattcaaacaagagtgtccagaaaaaattttcttttatagtccacagtatggtgttaatggtgtgtgtgcagaatatgcagtaaaacaggggagacaggcatattttatagaaggtagctctagcaatgctgaacgatatagtgctttaagggtgtgggagtggagtaaatttaaattagtaaaccctgcattgcagcattggcaagctgttaaaaatttagtaacgcttgaagatattgatagagtctctgcacatattcacgaattattcaaaggtaaatcttttgctgttttttcagcgccaaaaacaggaaatttttcaatccgtgaaaaattcaatattccacagaatgctaaaattctactcgcctcattaagtagttttgatgaagcgtatgcggcttttgttatcaaaggttttcctgagcgtaaagttaaaagtccggttttctcagatcagtttgaatggattaagtgtacaattaattttatgaagtctaggcctgatgactatcttgtaattagagtacatccgcgagactatcctaataaacgcgattccaatcagtctgagcaagcattgatttgggaaaaaatacttcaggatctccctgagaatgttaaattaaactcaccagatcagaatatttctttatacgattttctcgatgatgtacatgcgctggtaacagggtggtctgccactggtgtagaagcattgctacatggcatacctgtgattacctatgataaatacttaccttcctatccggcggatatacatctaacgggagagtctgaacatgagtattatgacaaccttatcaaagtactttctttggcaacatcaacagataatacacatgtagttaatgcctatcgctggctcgcggtcagtttttcactgggcactgtcagagttaatcagccactggagattggtctgagttggccggataagccggcgtatagaatattgaaaagggtggctaacaagttttcagttaatttgcgaaaaagctacgacgtatggaatgtccagtccaacgacacagaccgtttaagatttttaagtctggttcttaataatcaatctagcctttttgagggtgtaatatctgatgtggtcgatgctgtttccgattatgaaattgaagctacggtaaaacaacattcgatataa

SEQ ID NO: 159 - DNA, 1707 bp, Methylobacillus glycogenes
ttgaataaattgccacaagcaaaatatatttttaagttattaaaatttgctttcaataacaacccattgttgtatttgagtgttttaatttctatactttctataggtattgaattgttggcaatggcaagcctattgcctttatttgaacttgtttcaggagaaacagtagataagcatggtttgatttcaaaagctctgattatattggggtttacagttgatgctgccagccttttgcaagttttcttcttattgttcactttgagagtagtcacgcaactatttagtcaaagcctgacgcactaccttggaagacgtgtgatggctcagctcggttctagggcttttgaaaaaatcattacttcgatgtcaattgataaaatatctgaaaaaagtataggtttttttatggggcttgctggagatgaatccttcagggcgagtactctggttgttgcattgactcagtttgttgcaacatttttactgggggtaatgtattttatttctattgcaatttattcactatatgccgccgaaatgattttcattttaatgcttgtgtctgccgtattcttcatttggattttaaaaatatctcataagatgggcgtgaggcaaatagaaggttcaaggaaagcaaattccattttcatggatgcgatgaacaatatcaaagcagtaagatcactttcttccgagaagtatgttgccggtttgtataggcgaaagatttttacgtatgcaaatattcttttttaccttgatgcaataaatctggctacgaagttagtaccaataatatttctattactcggatctttggctttgatattgagtggctgggtttctgttgaaaacttagggatggcttacattgtgtcattgatagcttatctcatgcgatttttcccagttgttggtcagagtatcactctagctgttcgcattgttgcagatgcgaaatcgggaaaagatgtgacggaattagtttccgatgaaagtgccgagagcgctaattcagacaactatttacacaagatagatacaatcaagattgataatttgtcgttttcataccgtgatgttcaaggcgtaaggccagcggttctcaattctgtttactacgagtttgaaaagaacaactcttatgctttagtggggaaatctggtttaggaaagtctactttgctggatgttttgctgaagttttatcctcctgcttcaggcagtatttcaatagatggtatttcaacagaaaatatccctggagcacatatcaggcattctattgtacttattaatcaagaacctgcgatttttgatgatacggtctacaacaatatttgtatgggcgagacttttactctagaggacgtaaaatgggcttgcgaattagcttgtatttctaaagatgtggaaagtcttgcgcaaggttatgaaacacgtttgcaatatcaaggaaaaaatctttcaggtgggcagcgtcagcgtatagctattgccagagcattagtgcgcaaacctaatgtgctgatacttgatgaaagtacaacagctttagataaggctacacaagaaattgtgatacggaatcttatgaatgagtatgaaaataagatcattatatttgtcagtcatgatccttatatcatgtctcaagtcgatcatacagttgatttggcattaatcaataaagtataa

SEQ ID NO: 160 - DNA, 699 bp, Methylobacillus glycogenes
atgtctatctcaagtattgctttaaaaatatttaattattcgcaagagattttttcattttaccgggatagaggcttatataaattctcttatgcgcaagagggggaagatttaattctgagtagaatttttgaccgaacctctactgggtattatattgatataggtgctcatcacccagtaaggttctccaatacttatttattttataaacgtggttggaggggagtttgtatagatccctcacacgaggctattgctttgtttaaaacacggcgcccagcagatattgccttggaaatgggggtatctgatcatgagtctgagctgacttatcatatgttcgatgagcctgctctcaataccttcagtgaggaattggccaatcagcgtatacaaaacactgcttataaacgcgtcggtacccgcaaggtgccagtaagacccttgactaaaattttggatgaagtgctgctgccggatactgaaattgatttcatgagtatagatgttgaaggctttgattaccaagtgcttgcctctaacgactggtcaaagtacaggcctcgtatagttctggcagaagcacttgatgatgtcgctggcgaacgcatacgcagtttcatgattcaaaatcattacaaagtcatagcgcgtacattcaacactgagttttatcaagatcttttgaaactgtaa

SEQ ID NO: 161 - DNA, 906 bp, Methylobacillus glycogenes
atgtccaatctagcacctgttgccctgtttacttataaccgccctgaccatactaaaaggacgattgaagcactgaagaataataccttgtctgctgaaacggacttgctgattttttctgatgctgcaaaaaatattacacagcaaagcatggtggatgctgtcagagcgtttactcacactgttgaaggcttcaagtcagtaagaatcatagaacgtcaaacgaattttgggctagctgcttcgattattgatggtgtaacaaatgtacttgcagagtatggtcgcataatagttcttgaagacgacatggtcaccagtccatattttcttcaatacatgaatgatagcttgagtcagtatgctgattttcatgaagttgcaagtattcatgcctatgtttatcccatcgcaggattgcccgatactttctttttgcgtggtgcagattgctggggctgggctacatggagggatagatgggattggtttgaaccagatggaagtaagttgtttgcgcaactgaagcagcttaacttgctgaataagtttgattataacggtagttatccattttcaaatatgttgcgcgaccagattgcaggaaccaataattcttgggcaatacgttggcatgctagtgctttcttgcttaataagttgacgctttatcctggtaaagctttgcttagtaatattggacatgatggatccggtgtgcattgtggagaaagcgaaacatactctgcggagttgagagctgaccgattactattgactgatattccattgcgcgagtctgagccggcatttaagaaatttgagcaattttttcttgaaagcaaaccatcagttgttcgcaaaatgatgctgaaggcaaaatccgtatttaaaaaatttttatga

SEQ ID NO: 162 - DNA, 816 bp, Methylobacillus glycogenes
atgagttttatcaagatcctaaaattattatgccccccactttttctgcatattctgcagaagtataggcggcgtaactttgcctcttcgttcgccggaaattattcttcttgggcgcatgctaaacaaaatagtggtggctatgatgcggaaaatattctcaccatcattcaagagtcagctctcaaagtcaagcgtggtgaagcggtttttgaacgagattcagtatgtttccatcatgttgagtatagatattccgctttgtctggattgctatacgcagctgttagttctggtggcaagttgagtgtcctggattttggaggctctctggcaagtttttattctcagcatgctgcaatattgtctatagttaaggatttgcgttggggagttgttgagcagccacattttgttgcctggggtcgcgagcacctaaccacaactgatcttaaattttacaatagcctcacagagtttattttggatggaaaacccaatgttatttttctttccagcgtcctgcaatatttggagcatccataccagctgttagaagaattattgaggctagattctgagtttattcttttcgatcgcacggctttttatgacgttgttgaccgcttaactgtccagacagtgcctgcatcgatttatccggcaagttaccctgcctggttcatttcttgggacaaatttataaatactatgagtgcaggagggtatgaggtcatcatggagtttccttgtgcagacctgacggacataggctattacaaagggctttttttcaagcgcaagagtgtaagttga

SEQ ID NO: 163 - DNA, 999 bp, Methylobacillus glycogenes
atgaatgatgaactgtactcaggtaagaatattcttgttactggtggcttgggttttattggttcaaacttggtcaaaagattaattgcgcacaaagccaaggtgaccgttgtagatagcctgttacctctttatggtggcaatgcctttaaccttagtggctatgaatcgctggtcaatatcaacatcagcgatgtacgtgatagtcatgccatggcttatcttatcaaaggcaaggattacctttttaaccttgctggacaaactagccatttggattccatgaccgaccccaggacggatctggatatcaatgccgcagcacaattatccattctggaagcatgccgacagcataatcccgatgtcagaatagtcttcgctagcaccagacagctttatggcaagcctgagtatttacctgtagatgagtcacacccgattcagccagtggatgtgaatggcatcaataaattggcaggggagtggtatcacattctctataacaatgtttacggtatcaaagcctgtgcgctacgtctgacaaatacatatggtcctggcatgcgcgtcaaggatgcccgtcagacttttcttgggatttggttgcgtagagtgattgaaggcaagccaattgcggtatttggagatggcttgcaattgagggatttcaattacgttgatgatgtggtggatgctctgttactggctgccgccaatacagaagcagatgggcaaatatttaatctcggcagtgatgaggttgtaaatttacagcaagtagctgaattaatgacacaatttcagcctggttccagctatgagattgtgccattcccacctgagagaaaagccattgatatcggtgactactatagtgatttcaataaaatcaagcaggttttaggttggagcccccgtgtgggcttgcaacaagggcttgctgcaagcctggcatactatcgccagcatcatgataaatattgggacaacgtatga

SEQ ID NO: 164 - DNA, 1101 bp, Methylobacillus glycogenes
atgattttaatgaatgacttcaaggctgaaccagaagctttgattgcagcgcagctgcaagccgtcgagcgtgtgctgcgctccggttggtatgtattaggtgaggaggggcgcaagtttgagtcattgtggtctcagcgttgcggcacttctcatacagtgggtgttggcaatggcatggatgcgattgagataggattgcgcgcgctggacattgggcccggtgatgaggtgattaccactgcgatgacggcttttgcctctgtgctggcgatcatacgtgcaggtgctacgccggtcttggccgatattgatcctgacactggcttattgagtcatgaaagtgtcaagcgatgcatcaactcgcgaacgaaagcggtcttgctagtccatctatacgggcaaatcagggatatgcaatcctggctgaacttgtgcgatcagcatcaagtggctttgttggaagattgtgctcaagcacatttggcgcaagcggaaggtaaagtggcggggagttttggtcgctttggtgcttacagcttttatccgaccaaaaacctgggcgccattggcgatggaggggctttggtaacatctcaatctgcgctggcagacaaggctgcagtgttaagaaattatggccaaagtgtgcgttaccatcatccagagtttggcttgaatagtcgtcttgacgaaattcaggcggccttgctcacggtaaggctagagtggctggaacaatatacaagtcataggcaatcaattgccgctcaatacaggcagcagttgaataatccatacgtgcgcctcatgcaaactccaacagagccattagcccatgtctatcatttgtttgttgtgctaacggagcaccgtgaagcattgcaggctcacttgcaggcaaatggcgttcaggcattgattcattatcctgtgcctattcatcatcaggaaaagtgcagcgatatattgagagatccggctgggctgcaatttagtgaggcccatgcacagcaatgcctttcgctgccatgtcatcctcaaatgtctgaacaagatgttcagaccgtcattgctgcagtcaataggtttgcactgtaa

SEQ ID NO: 165 - DNA, 942 bp, Methylobacillus glycogenes
atggagcattttgtcacactgtttgatagcaagtttctgcctcaaggtttgtgcctgcatgagtcgctggcccgccatgccagggattttcatttatggatagtctgtatggataaagtggtgcatgagcaactggaaaaattgcagttgcctcatgtttcgcttatgcgcttggccgattttgaaagcgaggcattattggccgttaaaccaggcagaacaaagggggagtattgctggaccataaccccattcactgccgaatgggtgtttgctcaacacccagaggtggcacgagtcacttatcttgatgcagatttattttttttcaacgatcctgcgatactttttcatgagtttgaacaaagcggcaagcatgtgatgattactgagcatgcatatgcacccgattacattcagcatctggaaacgagtggacggttttgtgtgcaattcatggtatttgatcgaagtgaagcatcccgtaaagttatgcattggtggcaagatcgctgcgtggagtggtgttttgcaaggatggaggatggaaagtttggtgatcagaaatatttagatttatggcctacaatttttgccgatgatgtccacatattgaagtgcgttgaacaaacgttggcaccttggaatgtagactatcaacttcagcaccaaagtgggaaattcaagccggttttttaccactttcatgcattccgcataatcaagtttaatcttgtcagactttatgaagggtaccagatagctaaaagttctcgttacctctatgacgagtatcttgcgactttgcagaaaaaaattgggatgttgcatcggtttgccattccgttgccattgttgccagaaaaatgtggtattaggccaaaattggcttcttattacacatggatcagaggatttaccgctacagctaagatcaaataa

SEQ ID NO: 166 - DNA, 768 bp, Methylobacillus glycogenes
atgcaaaaacttagtgtgattacggcaacatataatgccgctaaaaatttaccagatttagtgcaaagcctgcttagtcaaactgatatggatttcgagtgggtcgttgcagatggcggttcaagtgacgaaactatatcttatctaaaaagcgttgtaggcattaatcttttgctgtcagcgcaacaggattttggtatatacgatgcattaaatcgtgcgatttcgctaagctcaggcgattattatttggtcttgggtgccgatgatattttgtatccacatgctgtcgaggcgtttaagcgtgcggctggcataggtctgcctgatctcgtcaccgcaagtgtagagtcagatcatggtgtcatgattgctggaagtggcaggccatttttgcgcggacaattggcttatatttccaatcattctgtcggtactatgatcaaaaaaagtttgcatgatcgttttggttattactcccgccgattccctatcacggcagatcagtattttatcaagcgtgtttgtggcgctagcgaaacggtgatttacaaagcagattttgtagcaggctattatccagctacaggcgtgtcaggagcagatgtccctgggacgatggttgaatttttccgcgtgcaattggaaaccgaacctaattcagtgctccagctagtacttttcattttgcgtttgatacgccatacccccaagctcatccggtatgcacactacaaaaaattgcgcgatctaccccagcatgaatag

SEQ ID NO: 167 - DNA, 1083 bp, Methylobacillus glycogenes
atgaatagcaacgtattgtttatcactggctttcatcctggaggtatgggttttattggtgcaggtgaggcaatcagtcagcaacatatagagcgactgataaagcaaggaaggaaagtgcatgtgctggcacttgcccctaattatcaagtcgccagtcctgaggttgttgcaagctgtgcttcctacaccacgcttacgcatacgcgatggatgacgtttgcagctttatggcgctcacgccagcagggaagtctgctctgcccctggttatttacgcgtgtatcaccgcaagctgaacgttttatccgtcagttgttggaccaacacgccattactgagatctatcttgattttccatcttgtcttggcttcgcgccaacatacaatcaattacccattcattacattgttcatgatgtgttgtcgcaaaaagttgagcgacgtcctttattaaaatggctgaaaaatcaagtgttgcgcacggaatcgtccctgctgcgtcatgtcacccagtgtttcacactttccctgaaggacaagctgagatgcgaggaaatagggtatagcggccagatagaggtgcaggtgccgcacattctcaaggtaggggttgttaatcaaggagtgccaattgcagggatcctcaagcaatttcctggcaagaaaaacctggttttttttggcaacatgcagcgggctgaaaatcattactccatcttaagatttttgttgtgcagttatcctggcatctggttggagcatcgcgatgttcagtgctggatattaggtttggcaccaagaacgctattgcgttggatatcgaaagtgttgcctggtgttagagtcactggcgctgttgatgacccaactgaggcgtttaaggcggcaactttatgtattgcacctgtatattacggtgctggtgtgaaaatcaaagttttacaaatgctggaatcgggagccacagttatatcgacgccagtcggagctgagggtattcacggcagtgaaaaactcattacggtggaaagtgctcgtctatcctccactatcaagcaacgtttggcagttgaatcatga

SEQ ID NO: 168 - DNA, 924 bp, Methylobacillus glycogenes
atgaatcagcatgaactccccagcgttgcagtgttgttggccagtttcaacggtagggcttggatagcggagcagcttgccagtattcttgctcaacagggtgtcaagcttcatgtgtttattgcggacgacttatccactgatggcacttgggagtggttgaatgtagaggctgcttgtcatcaaaacgtgactttgctgccacataatcagcgtgcaggttctgcgggcaggaatttttatcgtttgatccacgaagttgatctggatggtttcgatttcgttgcatttgcagatcaagatgatgtgtgggatagctataagttgagcaggcatgcacgcttgatgaagctacatcaggctgatggtgtgtcttccaatgttgaggcattttggcctgacggcagagtgatgctgatcgttaaatctcaagctcagcggcagtttgattatctcttcgaatctgctgggccaggttgtactttcttgatgactactcgcctcgcacatcaagtgcgcaatgtgctccaagatgagctatctccagcgcgggatgttactttgcatgattggctaacttatgcaattgcacgttccttgggatatacctgggtgatagatgctaacccttctctgaaatatcggcagcatggcaataatgtgattggggccaatgtcagtcttaaagcgaaatggacgagattgaaacaaatccgcgatggctggtatcgccagcaagtcattaaggtgacacgcatcgcttatgctttttctcagcgcgaagatttgcagcgcttattggttttgctggagaagccttcacttggaaaccgcctgcagttattgccatatgcctggcatggaaggcgatcagtgaaggatcgtttattcctgatgtttagtattgtgtttaagtggttttga

SEQ ID NO: 169 - DNA, 954 bp, Methylobacillus glycogenes
atgagtcagcaacatattttggttaccggagctaatggctttgtgggtcgatcactatgcaatcaattatgccaatcagcctttcaagtcacccaggttggacgtgctctaaatagcgctgatgggggagcatatagccaggttgtgtcgatagatggaacaacggattggtcgaccatcttggatgaggttgaggtagtgatacatcttgctgccagagttcatgtgatgcaggaaaacttagttgatccaatcgtggcttactggcaaaccaatgtcgagggcaccttgaatttggccaggcaagcgctaaatgctggggttaaacgctttatttttgtaagttccatcaaggttaatggcgagcaaagtttcccaggcaaaccatttactgcagaagatatgcctatgccagaagatgcctatggcaaatccaagtgggaggcggagcagggcttgcttgcattggcaaaggattcaaatatggttgtggtcattattcgcccacctctggtttatggtcccggtgtaaaaggtaatttttccaccatgatcaaactgctgcagacaggcttgccattgcctttcggggcgattgccaatcaacggtctttggttgctatcgataatttgatccacttaattatggtgtgtattaatcatccggccgccgccaatcaggttttcttagtcagtgatggtgaggatttgtctactaccgctttattgcgtcgcttggctctagcggctggcgtatcatctagattgattccctttcctgcagcatgggtcaacttcgtctttactgttctgggtaagaaaatgatggcagggagaattttagggtctttgcaggtggatatcagcaagacacgcgaggtattaggctggcagcctcctgtgacagttgatcaagggctgcgaaattgttttccaactaaggctgagccgtga

SEQ ID NO: 170 - DNA, 552 bp, Methylobacillus glycogenes
gtgattcgtttttttgacattgtattttccttgcttggcctggtattcggtttgccattattgataataatttatctggtcggcttgctcgatacaggctctcccttattccgccaagtgagggtagggcggcatcgccagccatttacgctggtgaaattccgcaccatgaaagtcaacacagcatcagttgccagtcatctggcttctgccagctctattacttggttaggtagttttttacgcagtacaaagttagatgaattgccgcagctttggaatgtgctcaagggcgagatgagcttggtggggccgcggccgaatttgtttaatcaggatgagttgattgcagcgcgtgatgcacggggtgtttatgcagttcgaccaggcatcaccggactggctcaggtgaatgacattgatatgtctatgccaaagttgcttgcagagacagatgcttctatgttgcagcaattaaatttaaagctttatttcaagctgttaattcagactgtattgggcaaggggcgtggtgacagggtcgtgcggtga

SEQ ID NO: 171 - DNA, 1816 bp, Methylobacillus glycogenes
atgcttgcgtggtgggtagcatttcttttccgcttcaattttgatatccctgccccatttgccgagagcatgttgcaaagtgcagcttgggttattcccctgcaagcaacatttttcctgctatgcggcctttaccgcggtgtatggcgttttgccagtctgccggatttacagcggctgattcgagcgattggggtggccgcagtagttgtggtagcaattttgtttatgttccagccacatggggttgtgccgcgctcggtgttgatcatgaatcccatgctgctgcttttgttgatgggtggcagccgcattgcctaccgcgcctggaaagagcatcgactgtatggcgcggcccaatcctcaggtaagccagtgttggtgcttggcgccggggatgccgcgattgccttgctcaaggatttatccaagagtcatgagtggcgcatagtgggcttgcttgatgataagcaatcaatgttcggccgtgagttgcttggtgtaaaagtgctaggcaaactcagcgattttcctgagatcgccaaggcaatgtctgttcagcatgtgattgtggccattccttcggcgcgcaacaacgcaggcgccagattattgatatggccagtcagcacaaactcaaggtacttaccgtgccatcactggaagatttgatgagtgggcgtgtcagcatggcgcagctacgtccggttgaggttgaagatttgcttgggcgtgagcctgtggtgttggacgatgatggtttgcaccagttgatcgatagtcaggtggttatggtcactggcgcgggcggctcgattggttcagaactttgccgacagttactcaagtttcagccttcaatgctggtgtgtttcgaccattcggagttttctctttatagcctagagcaagaactgaccgctttaaagctggatgtgcggattgaatatctggtaggggacgtcaagaatgcacgacgcgtgcagcacgtgcttgctagttatcagccagcacagtatttcatgctgcagcctataaacatgtgcctatgatggaaaaccgtaacgttgcagagtcattatccaataatgtgctgggtactttcacagtagccagtgcatgtaaggcggcgggcgttaataagtttgtgctggtatccacagataaagcggttaacccaaccaatgtcatgggggctagcaaacgtctggctgaaatggtgtgtcaaggtttgcaggcggaaacaggaacccgctttgtggtagtgcgtttcggcaatgtgctgggcagcagtggtagtgtgatccctaagtttaaagagcaaattgcgcttggtgggccagtcaccgttactcatcccgagatcacgcgttatttcatgtctatacctgaggcgtgccagttggtcatgcaagccggattgatgggtaagggcggagaaatattcgtgctagatatgggtgaccccatcaagattgtggacttggcgcgtgctatgattaggttgtcagggttgggggatgatgaggtcgacattgttttttccggcctgcgccctggcgagaagctgtacgaggaacttttggcagacgacgaactcactttaccgacgccgcacgataaattgcgtatcgccgtggctagaagtgcagatgaggcctgggttgtggctttgctcaagtgggtagacaagtcatccagcatggatgaggcagtcgtgaagcaagagctcaagatgtgggtggaggagtatgcaggtgatatacatgctagtctttcttctgcgttgactcccgggtcatcgacaatacattaa

SEQ ID NO: 172 - DNA, 876 bp, Methylobacillus glycogenes
atgacaaaaaaaattaccaaggcagtcttccccgtggcaggtcttggcacgcgtttcttgccggccaccaaagccagccccaaagagatgctgcctatcgttgataaacctctgattcagtatgccgcggaagaagcagttgctgctggtgcaactgaactgatctttattattggtcgcaataagcgctccattcctgatcattttgacaagtcttttgaacttgaagcttccctagaagccagcaagaaaaccaagatgcttgaggaaattcagaacattctacccaagcacgtttcctgcatttatatccgtcaagctgaagctttgggcttgggccacgcggtgttgctggctaaatctgtcgtgggtaatgaaccgttctctgtcattttggcagatgacttgattgatgctgaaaagcctgcgatgcaacaaatgactgagttgtttgaaaagcaaggagcttcaattcttggtgttgaagatgttgagccaagcgagacagcaagctacggtattgttgatgcagtggaattgacaggcccagatgtattgcagctgaacggcattgttgaaaagccacagcctgaagatgcaccttctaacctggcggtggttggacgttatattttgactcctgaaatcttcacctgccttgagaatgtcaagccaggtaagggtggggaaattcaattgaccgatggtattgctgcgctgatggagcaacaaaagattctggcttatcgcttcaagggtaagcgttacgactgcggcagcaagttgggctatgtcaaagccaatgtcgagttttcgcttaagcatgaagaaattggtgaggagttctcgcagtatctgcgtgaattgaccaagtaa

SEQ ID NO: 173 - DNA, 26858 bp, Methylobacillus flagellatus
tcagcctctctgggcaaggttttgctgccaatgccaactatccttgcacatctgctcgatgccacgcgtcgctttccaacccaatgcctgctcggcataagcaggatcggtataactggccgccacatcacccggccggcgtgccaccagctgatagggaacagcctggccactggcgtcttcaaatgccttgaccatttccagcacgctatatccttggcccgtgccaagattgcatgtgaacacaccagcttccttatccagccgctccagggcacgcaaatggccaaccaccaggtcgaccacatggatgtagtcgcgcacgcccgtaccatccacggttggatagtcactgccaaacacagaaagagattcacgctgcccctgggctacctgggtgatgtatggcatgaggttattgggcataccattcgggttctcaccaatgaggccgctctcatgcgcgcccacaggattgaaataacgcaggatggcaatacgccactctggatcggagactgccaagtcgcgcaggatatcctccaccatcagcttgcttgccccataaggattggtcgcagacaacgggaaatcctcgcgaatcggcacactggctggatcgccatacacagtagcggacgaactgaagactaatcgtttgacgtcatgcgcctgcatgacgcgcagcaaggtaacactacccgccacattgttatcgtaataacgcaaaggctgcgcgaccgactcccccaccgccttgagcccggcaaaatgcatgactgcctggaatgggtacctagaaaataaatcactcagtagtgcttcatcccgcacatccccttccaccaatacgggtgccttgcccgtgatctgcttgatgcggtcaacgatatgcgcctggctattgctgaaattatccagcaccaccacctcatagcccgcattaatcagttccacacatgcgtgggaacctatgtagcctgtaccgcctgttactaataacattaaaaacttttcctttagtccaatagccctattgaagcgccacacatatttatagtagctttataaacatagaaaacttttaaaaaaatctgaattagaaagttaagctaccattctgtgatagccttcttgtaatataaaccagtaaataataatttcaccacacccgcaaataatccagatattaagtgagttaatagattgacgacattaaataacactatcattgtcactggtggcgcaggcttcatcggtggcaacttcgtactcgactgggtcaaggcaggactaggcaccgtcatcaacctggacaaattgacctatgccggaaatcttgaaaacctggcagacattgaaggcaaccccaaccacatcttcgtacatggcgatattggtgaccgcgccttggtcgccaagttgctggcagaacacaaaccccgtgcagtcatcaactttgccgccgaaagccatgttgaccgttccatccatggcccggaagacttcattcagaccaatgtagtcggcaccttccacttactggaagaagtacgcgcctactggaatagcgtggtgaaaacccacccagaggaaaaagaaaatcctcagttccgcttcctgcacgtctctacagatgaggtgtatggcacactgggccccaaggaccaagcgtttacggaaaccaccccttacgcccccaatagtccatactcggcttccaaggcagcctcggatcatctagtgcgtgcctaccaccacacttatggcttgccggtattgaccaccaactgctccaataactatgggccttaccatttccctgaaaaattgattccactatgcctgctcaatgcgcttgctggtaaaccattgcctatttacggtgacggccagcaaatccgcgactggctattcgtcaaggatcattgcagcgccatccgccgcgtactggaagcaggccagctcggggaaacctacaatgtgggcggttggaacgaaaaggccaatctcgatgtagtacagaccttatgcagcatcctggatgaactcagccccaaggcagatggctcaagctacaaagaccaaatcacattcgtcaaggaccgtccaggccatgaccggcgctacgcaatcgatgcaagcaaactggagcgcgagttgggctggaagcctgcggaaaccttcgagtcaggcatcagaaaaaccgtggaatggtatctgcaaaaccaggcatgggtgcacaacgtcaccagtggagaataccgcaactgggtcagcaagcaatatagcgggagcgcagcatgagaaaaggcatcatcctcgccggtggatcgggcacccggctttaccctgtcacccaggcagtctccaagcaactgctgcccgtgtatgacaagcccatgatctactatcccttgtccacgctcatgctggctgggatacgcgacatcctcctgatctcaactccgcaggacacaccacgctttgaacagctattgggtgatggcagtcaatggggactcaatattgcctatgcagtacagccctccccagatggattggcccaagcctttatcatcggcaagaaatttattggcaatgatccaagtgccctggtgcttggcgacaacatcttctatggtcatgacctggcacatgacctggcacatgccgatcaacggcagcatggcgccactgtatttgcctaccctgttcacgaccctgaacgttatggcgtggtcgagttcaacgatgctggccaggctatcagcctggaagaaaagcccaaagagccaaaatcccgctatgccgttactggactgtatttctatgacaaccaggtcgttgacattgccgccagcctcaaaccatctcctcgaggcgaacttgaaattaccgatgtcaacaaaatttacctggaaaggcgctccctcaatgtggaattgatggggcgcggtcatgcctggttggatacaggaacgcatgaatccctgctagaagcctcactattcatcgaaaccatagaaaagcgacaaggcctgaaagtcgcctgccccgaagaaatcgcttaccgcaaaggttacatcgatgcagaacaagtagaaaaaattgcccagccatacctcaagaatggttacggccaatatttgatccggatgctgaaagaaaaggtcttttaatgaatgtcacgcccacccatattcctgatgtgatcgtattcgaacccaagatattcggtgatgcccggggattcttttttgaaagcttcaatcagaaagcctttgaggaagccgtcggcaggaaatatgattttgtacaagacaaccactcaaaatcctcaaaaggagtattgagagggctacattatcagatccagcaagcccaaggaaaattggttagagtagtagcaggtgaagtttttgacgttgccgtggatatccgcaaatcttctccaacctttggtcaatgggtagggcaacatctgtcagcagaaaacaagaaacaaatgtgggtaccaccaggttttgcccacggcttcctcgtgctgtccgaaactgcagagtttctctataagaccacagacttctacgcgcctgcgcatgaacgttgcctaagctggaacgatcccgttgttggtattgaatggccagatattggcacgcccccgctcctctcaagtaaagatcaacaaggcttaggcctccaccagacagagttattcgcataatggcaactttcaacaagatcctgcttaccggcatcaacggccaggtaggccatgctctctatccgaaactacaaagcttgggagaagtcgttgcacttgaccgcagccaacttgacctatccaaacctgaccatatccgggacgtagtgcgacagaccaaaccagacctcataatcaaccctgcagcttatactgctgtggataaagcggaatctgagccggagctggcctacgccatcaatggcactgctcccggcattctggctgaagaagcagcaaagctaaatgcattgcttgtgcattattctacggattatgtatttgatggcaccaaaactaccccttacacagaattggatgaaacaaatccacttagcgtttatggagccagcaagttagcaggagaaaaagccattcaagaagtcggagcaaatcatctaatcttcaggaccagctgggtttatggtgcatatggaaaaaatttcatgcgcaccatattgagattagctgccgagcgtgactcattgaatatagtcgcagaccagtttggcgcaccaacttctaccgaaagcattgcagatgcaactattactgcgctgcacgcatgggatgggactcaaagaggtgtctatcacttagtcaatactggggagacgagctggcatggctttgcactggaaatcattcgccagtatggagaaatagcccaaaagaaaaatttagcgaaattaaaatccactgtagaaaatgttgtcggtattacaactgcagaataccccacaccagctcatcgccccgccaactccaagatgagcactgaaaaattcatgagcactttcaaaactgaattagcaccatgggaattggctttgcgatctacagtaacccacttagcaacattctcggtcgaaaatcattagcattattactaattaatcattaaaactgacttcagtcagaccaagggaaattattcatgaacgtccatattgatcattgaagcgaacaatatcatcttcacccaaataagccccagactgaacctctatcatttctaaaggaagctttcctggattagccagcatatgcgtcacacctaaaggaatataagtagactggttttcagaaacaaggaactcctcatctcctcttgttaccttcgctgtaccggtcaccacaatccagtgctcggctctatggtgatgcatttgaagagataacgtagcacctggattcactacaatacgttttacttggaaccgtgcccccatatcaatactgtcataccagccccaggggcggtgaaccttgcggtgagtcttggcctcgggccttttctggaccttaagctgctccacgatttttttcacatcctgagttttacttttatctataactagcaccgcatctgctgtctcaatcaccgcgatgttttgcagacccacacatgcaagcagcctacctgaagacacagctagagtattcgagcaatcattgaacagcacatctcctaaatgggagttacccgcgttatcctgcggcaaaattttcccgaatgaatcccaggccccaacatctgaccagccggcattcagggggatgactatgcctgcaggcagattatcggcaccacgagcgacatgctccatcaccgcatagtctatagaatcgctaggtacctgttgaaatttaagcttgtccacccgaacaaaatcgccatcgcgttgttgaccatcccaagcctgcttacatgaagataagatatctggacgagtcttagcaatcgcattcagccataccgtggcacgcatcatgaacagaccgctgttccagaaataattcccacttactacatattgctgagcagtagcctcatcaggcttctcaacaaactgctcaatactgaaagcagaaccgaaaccttccagcactgcgcctgacttgatataaccatagccagtttctgccctatcgggcacgataccgaaggtgacgatcttaccagcagcggcatgttcagcccctgtcctcacggtatcctgaaagtcttgcacattgataatagcgtgatcggcgggcatgacaagtaagattggatcctggccgtggctggcagcctctaaggcagccaaggtgagcgcaggggcagtgttcttgcctacaggctcaaggagaatagatccacgccttcccatcatccgcaattgctcagcgataacaaagcgatattcttcattacataccagaattggagaacactcggttccaatgagtggatcgaccctgcgtaatgtcgactgaagtaaagaatcattatcaagcaatgtcagcaattgcttgggatagttttctcgagaaagaggccacaaccttgtgccagagccacctgataaaatcacggcttgaatctgcataattttctcactggatagaaatataaagggaaagaaataggcacagtatctaattacttatttggcaaaaaccttgtcagcaaggcctcatattgctgcaacactgagtcccaggtaaataaggtatcgtattgagccaagctaccggctctcatctcacgtaaccgaacttcatcattaagaagctcatcaagagtgatttcgcagtccttttcaccagaaaagtaggccgccttatctccagcgacccagcggttaaaacggttatcgtgcgccaatactgcattaccagcccctagtgcctccaccaaagaaggattggtgccgccaacttggtggccgtgaatatataatcttgagaaataccgtaaagattcgaccacgtgtttatcataaattgcgccaggaaaaagcacctcgtctgagccggcagctttaaccgcgacctgataagcatggtcagggttatattttcctagcactacaagcctcatgcctcgaggtttagcggaccaggctttcaccacctctaaaatagaattttcaggctctgcacgagcaattaagatcgcataactgaaaggcttaagtccatattcctccaaaacggcctgattcgcctcaatcactttatctgcgccgtatggaatcattgtgatcttgctaggcctgactcttgtttccagatgacgcgcaatttgcggatgatcagcaatcagatgattgcctaaaattgaaccagcccaatcattaatccagaaccagagtttagcaactgccccccattttttccgatgccactcgattccatccatattaattagattagttattcctttagttctatagagcccacagaataaagcagtgttatacccaagagttaaaataagatgataagtatttgaagcatgaatcgttgacttccaatcaaaaagaatagtgcctaaagaaccctggatagatatcggaatatttactcgctttataccattccacatatcctcatacataggcccattaccatctacttggcaataaactgttactttccacccttttctttcaagataaatagccaaatgctctgcaaatgtttcaaagccaccatgcgcagccggaattcctctggttcctaatattgctattttcttatgcatacaaatacaaactcatgttaaatgtgattctaatatttcttatttttattaaaatttttcatcaaaagctgaagtacaggaacattgttttgacgttcgacaatagcatcattcttgaatatactatctggcatttccgcatcccatccgctatattctctatagctatgatatgtccatgaccatttctcttgctcaaagcgctcaactacatctgtcaagtaacgtaacctcgaaccagacggagcccaccgaataatgctaaattcaccgatataaagaggaacattatatttattagcccaattacgagcaatgtctagtcgattatttaggtattctttatcccacttttcactgggatatatatatgcatgtgggtatgccgccaatccttgatgagtaagttcttggggagaataaaaatgaaagctgtaaactatattattaaatggaacaggagtaaactgctccaaactagaagccagcccccaaggactaggttccagaaaaattatatgattttcatctactttacgtatggcagtaatcaattcagtagcatacttttcccatactgatccaggcctaacaacaggctcattaatcaggtcaaaccctgccaccacagtctcatttttgtatcttttagcaatagttacccagttattcttaatgctttctcgtaattgttgattattccagtagatcgcctgatctccagcaggtttaggatcaaaagcaaaaattacataaaatcccaacttacgacctgcctccacaagaaaatccatttgcgacaactcaactggagaaatttcataatcattacattttttacatttttccaaatgaataacgcttcgaattaaattgacgttaaacttttcaagatcttccatgtcagcagaacttaatttccgcccaagaacattaaaccctcgataagaattttctttaaaatcgtctgaattaagaaaagctttcggtccttgcaaagccgcagaaaccttatcgaccgaagcagctgtagttgtttcagaagaagagccaccagcagaagaagagccaccagcagaagaagagccaccagcagaagaagagccaccagcagaagaagagccaccagcagaagaagagccaccagcagaagaagagccaccagcagaagaagagccaccagcagaagaagagccaccagcagcagaaggattgcttgaattgatagatttattagatgttgaatgctttatagttacattagaatcactactagactcatcaataggagcttctgtaacattagcagcagaaatagaattacttctggatttattagctgcagcctcagatttaacattcttcttataatcagaaggaaaaacctttatcttttgtgaattagcttgaggggtatcagaataagtggtactcccgtctacatctgtagatttataaacttcagcaataccaaccaaaggcataagggaaaacaaactaagtaaaacaatccttcgagagttaattaattgcatagttatggacctccaggctagatacgatcaaatcacgccacttcaaaaaaacactgtaaataaaaatccacacctattattaacggcaaaataatctaattatttagctaattttattattagctttaaaatttattttttacaattgacacctataaaaattaatatataaagattactcccgaagttaaattaaaaaactcataccttattaaagtcaaagataatcactatcaagctatagcaatggaaaataatccaaataaatataacatacaaaagagcctatttactgacatcacaattcagaagatgaaaaaatcaagaatcctaaccccattaagaattttactaaacatcaccgcaaaatatttttagatcaaacccgtttaccataatcttagcaaatacacattacgatatacttttctgataaacactgatagtttttatcgcaatctcatcccaactgaagcgagttctcatatcgttttctgcttgcaaagtaatcctagataagtcatggtaagaaaaaatttttacaagcttttcagcaagatcaatataatttccagcagaaaacaaaaatccgttttccccatcatttataatttgcgccatacccggaaggtctgaagctaacactggagttccataactcattgccattaataaaacaccactttgatatatttttctataaggcagaacaatcaagtctgccgcactataaaacattgatatctcttgatctggtatgtatctaatatccaatttacaaaaatcatttagcccgtttttacttattaattcttgatacttagagaaattatctttccacacttttccagcaatgactagcttaaatggttttagtttatctttaaccaaacctaacgcttcaatcaacaaatccaaaccttttacttctttgatttgaccaaaaaataaaattaccttttcatctgatgatacattaagagcttgacgagcatctgcttttggcatcgagggtgcaaccagaccaatataacttccgtgaggaattacatgtattttatttatagaaacattacttctattaatcaactcatccttactaacttgattgtgcacaattaattgattacagagaaagtaagtccattttaacaagatagagaaggttagacccggcttaaaagactcaacatcgtgcactgtagcaacaaccttaaatccaaataagcgaaaaaataatacacttaaaaattctaaaacacccacatgaaaaaaatgaaaatgggcaatatttgaataattttttttagcatgctttatgctcctacaaagccctaagatatacctagcccctcttctccacgtagcatcctttccccaaatatttacaaaagtaagttgcatgaaaataggtctattaccacaaggtttagaaatgtcacaggtataccaagttgcagatactccctgatgtaacaaaccggcacacagtccagaatcataatagtccataccaccgtgactaccaactggctccacaaaggcgacgttaatttctttcacataacacccaatctgaataattattttttacctgatacatatgtgtatttaacaaaatctttaatgcccaaaaataaagcattatatgcatcaagtctcttatatctgacccattcaaaagagtttcgaaacacccataacataaaacctattaaaaatagacctttcttaagcacagttccatgagtaaaaacagttaaaaatctatttttcgcagtttgataaacaaaaaaaggaagcttaggattccttcctttaaacataccaacagcctctacctctttgccctggctaccctgagccagatggcgaacaacagcttttggcatataataaattttatatccataagaaattactcttaaagataattcgacgtcttcttcgtacataaaatagcgtggatcgaacccgccacactcttctaaaactgaacgtctaatcataaaagcgcaaccactggcaaactctacaaatcgatcttctagagctatttttgatacagcacttaatccacaacctggtacgcgtgccgaaccagttaaccagttcatataccccccaccataccaaagtatatccaacccatcacccatcatagtaattcttggggtaaccaatccaacttcagggctaaaaaatccatcatgcagtaattgtaataatccaggttcaactagtgtgtctggattaagaaaaaatatatattcacaatctgtattaactataacccaatcttttccaatattgcatccctcaccaaagccaagatttttttcacttttaataagtacaacatctggaaactcttctacgatgcactcaggacaatcatccggagatgcattatccacaacaataatctttgaatatctctcttccctaagagagtaaatacaagaaataatttggtcactagtattataattaacaaaaactattgcaacacttaagtctaactttttttttgaactaaaatccgtcatcaataagcaccaataaaaattgcaaccatgaataaagaatcgttaacatatttttaaatccgttttgaagaaacaaaactccataatactttaaagaactctggtattgttttataaatagcaaagaacgggcttatataccacgggagaaatttaaacgcatattttgcccaaacaaattgaaaaaaacgaatcaatcgcatttttctagaacttgaaaactgcgttctaaatgttcgataatttaaacatgcttgcttgataaatattactgggcccaatttagcagcttgcaggaatagttgtatgtcatataaccctggattatttttaacgaaagaagacctcaaaaccacacacccttgctttaaagggtatactggtaaaataaagattccgaataaagtaaatagtgatgacagtacgcaatcatctgatacaaaaggaaaacgtgattctttataaatcctcccagactcatccatatatgccacagcaccaaatgcagccaaagcattgggatttgattccagtaagtcaagccgctttgacaaagatcccaatggaatagtgtcatcgtgatctaaaattagcaaatatttaccggtcgccaattcaataccagttctatatgagtcttcaataccagcattaatacttttaaaatgcaattttatatttggatgatcaatttcttgtaaatatttccgcgttccatcagtggatccatcatcaacgataatccactcaaagtcttcaacatctccttcaaggacactttttttagtatcctcaaaatatttcattgaattatatgttgccgtaataatactaattaatggagatgttttaacattcatctttaagttctcatattattttatataattatgactatatatatattccaatttacactttaagaagttagctttccttttgtaagatttttttgattaagataattagccgcgcacataagaccagcaagagtagccaaaaaagcaattcccggggtttgcattaattctggctgagtaatgcaggccaaaaaatactctatcattgcagcaaaagaagctatggcaacacttgatataaataaatcattagaccgcgtttgaatgtaagttaaatgaagtattttgaatataagaaaaatgactgacatgaatacaataatgcctgtttttaaggttaaatagatataagcactatgaacatatctcacttgctctgctgtcacatcagatttagcaggcggcctataaggggcaccaagcccaatgcctaataaaggtgaccgctgaattgccgcccatgccattttattttcataaaacctccagccgagagaagatccatgagaaacctcctcctccacactaaacaatctctgcatcgcgccttcaatagcgcccggcttaatagctagcatagcacttaaaccaaatacagcaacaattgcaattagtcctacacttctaagcattttttttgtccctagcttccagcataagaacaaaacagctaagaaagtccccccccaaacagcacgaccataggttaagaaaattccagcgcctgtaaatatacacaatataataagagtctttgaaaaacctattcggttagcaaacaaagccagtacaaacaaaaatccccaaacaataatgtgagttcctgacgtcatgcttcgtgtaacatcactattaatgcttcccaaagtttcaaggctagtaagctcgcgcccgaacacatttacacctagaaaaccttgcaaaatctggccaattgaaaataaaaaagctacaaaaagaaagccaaaaacaataaatttaaatctttgtctatctgagcatgttaaagctattaagggaatcaatagccaataaaggaaatgccttgactcccctaaaatatctttcaatggcaatctaatttcaaacaccgcccgaaatacagaaaaaagcaacagtaaaagtacaacaaataaaggaatagccaaaggtgacaatgcttgctttgtaaagctaaattctgaattgtatttaaaaaaacaaaaaatgaatgttgcaaacaaggccatatctgaagatggtattgtgcctcccagcagtcttattgaaggcaaaaatgtatctggaattaatctagaagaaattgctataacagctattaaagctactaaaggatatgtaaaaccaataaaaataaataatatagaaagaataatggctactatccaccaccatggaaaaatagcactgacaaaaccaaatatcaaagccactattgcagccattattacaaaaaatatactccctatctttaaactaacgaaattagcatccctacggttaaaagataagagagaagaattgttcttcataatgacgcattagccttgtgaaattttaatggtaccttctacctaatatttaatatatattaaatataactcaagacttcacctaaaggttttcggtatgattgcggaacaacaaatgattcccttaaatatccagcggcaacaaacatgataattaattcgttttctggtatacgaaggtgattcctcatttctatatcttgtttcctagttttactccagttaagagcgcaacttcctaggccttgcaaatgtaagccatatataaaactcattgcaaacattcccccatcaatccaaccttgataacgttccgccccattaaaatttgacaaatccactgttatacaaaataaagcctgaacctcttcataaaaccctcgtgcgcccccttgaatttgtaaagtactcctaattaattctggattaagaattgcccggacctttccagactgtcgattacaaactgctggacttttttgagcaatacgtacggccttttcaattacactatgctctataggatctttagtgaactgccttacactatggcgcataagaaaaaaatcttctttaaccccagatattgcgtctaaaacctcagctttagagcgcaaaataaccccgccatcattaatccttaataaagtgctctgattatttttctttaaccgatcaacgattacttctaattgagaatctggctgaccaagacttctattaaattgacaataacgcgccagtacatttatcggaacatctagctgtggatcaggcccaaaattaagatgaaaattatcgactgatccaactaattgtccaatcactacccttccaaataacggcctgggattaggtaaagacattcctttctcgatgttgtgataagtagcagtaataaccgcaagaatcttttcacgatctttctcgaaagaaattacagatgaccatttaatatatcgtttagcatcgtaacaaaagtctctcaataaactcgggcctcgaagacaaaatctcagaagccatttaatagaaagcggcaagaaaccaattatgtattttttcatcttacaactatacattctctaaaatatgtgttcaacttagtaaatttgacttttaacttataaaacaatctttttatttgaaattctagttaataattctgctatgtactgctcataacgcaatagttttttttctgcaattttattaccttcttctactgcaaacttcaactgctcccgactgttaaaacaatccataaccaaaccaactatttgctcgttagtattaaccttacaatccccaagataaggataatccaaggcagaaaaaagcccattaaacttcctactatacgctaatggcacaacaggcactccacttgaaaatgctgcgatacaagcatgcatgcgagctccaagaaaaaaatccatccctgaaataaaagatttagcttggctaggagaagaaaaagatggtgcaagcttagcagctggataaagctcttgtaattgaacacacacgttcacatcgtcttctataggaaatgaggtcgttagcacatgaggaacaagccatacttcacaaccttctattcgagtaaactgatctaatagtgatctagtaagttcaggataattaacactaagaccgaattgattcttcccagtatacccaccgttataaagtaatcctgatacatttagtccaatttttactttacttgaatcccgggaagggcgttgaaatggcaatctaaaagcaacgtcaattacctcctctgcatttacagataaattattcttttgcaagtatccaaatgacaatccatcccttacaaatattttagtgcaccgctgcattacattattggccacctttaaattaaacctactttcgaatggccctatagtttgcgggcttaaaataagaggtttacgttgaaacaagacaaccaacttagacacaatctgtattaggaatcgtgaaaaaccataaatatcagcaaaactatcaccttcacctatatcaaacaccacatcgcattcccggattttcttgggataatcagaagccccgatcaaaattcttttgagtgatacatttgtccctcgctcaattaaagggttgccctcaaagtaatctttgtttccattagtgccgaaaattcgatattcaacctcaacccccgcctgcaccgcagctttattaataatagaaatttgtgcttcagttaaagcgccaacaccaagattatctgaagtagtagaatgccaaagtaagcctattttcaacatgactaatataccaaaagaaaaatggaaagactaaatactattacagtcaaagtaaaattaactcccccaaacccagtaggtatttttctaagccgtaatgcactgaaaaatatcaaaaacaaggttaataatgtgatgattaaagcaatgaccataccttttagtccaatcactttcatcagaagtggtgctgaaattagcaaaataataagtgcaaaaatttgtgcccagacacgtattgtctgagatccagaagcagtcaatagaacaccttgaggcgcagcaagatatcttgtaaaaactaacaaaccaatatagggccaaattgaatttaactctacatattcatcaccaaaaacaaattcggtaatatgcataccggcaaaccagaaaatagcccagcacacagtaccaacagcaagcatctgaagattaagttttttagctagctcaacaaactctctagtattagtgtgcttggcagcaattacaggtaaaaatacatttccgagtacaggtgcaaattgcattgcaccatttagaaatctcatacctgcttggtaaataccaactccagtggctcccagataatatttcacaagcatggtgtcaacttggtagaaaaagttagtgaaacccgcatcaacggcatatggaaatcctgcttttaatgcttttagaacagcaactggagaggctgacagagtatttaaatcaccaaccactcgcttatatgcccgccacgacaaaataaaataaacaaaacgagataaaacaaaacctaaactaattaataataactcagccccattaattaccattaaaactattaagccgaaatgcaacaaagagccaattgttgcaacttttgtttcttcatgaaattttccgatacctctgaatgcaatattaaaaaaatccccaaaagaagtgagcaaacaagataacagtaaaatccaaaatattgctctatctaagtcatttgtatagaataagtaatgtccagcaaggcaacagacccccatcactactgtgagatatagttttgcaagaaaaaccctccccattaactgattaatattatcagggtatcttcctatatctcttaacaactgatttgaaaatccatattccactaaaagcacagctattgacgcaagagtaaaattgtacatcaatatgccaaagtctctcggaccaaggaatcttgcaagaataatgaaaagtacaaccgctgatagcaaccgtgaaaaagtcgaaagagccataaatgcggtatgtttaatcataaattgctacatttttattattaaagttaggttaaaaaaacattgaattttatgaaaatgtacctataagtttttttctacttttactatctacatttttcagtaaagatttaacaaattcttcttgcagtgtaaaagcagagatattatctctgctaatacttgaaactctaaaaagcagtccatcaggaatatatccctgcaaacctaattcaaacctttttatagtttgacccaatccaccataaactgtagtttcaccaacacgcatccaataaagtattggctcatatcgtgccccatgctgggctaataaatgtctaactttaatttcatatccatcaaaatttaaaatggcattacccaacaaatcaacattaaatccttgagctgtatagcaggtttcaggcttatgtgcttgcaagccgcgactttggtctcccccataagcaatcgaaagcattattcgcattccttgcttattaatataggtccgagaaagagtttgatcataaactttattgaggttttgctgcacctcagggctcacttgtataggagtaatcgtaggatcgattttccactcatcgaactccttaggaatcattgcttctaaatttatatcttctgctgcattaacaaacttagtaggtttaagaattactcctcctaaagtagctaccaataacagtaaaaatataattaaatttcgcagtgtaaatccatccattagacaggccttattaagagtttaggcttttaactgccattttttaaccaaatattgtaggagcgtatcaacactaattatcaaaattagagccactacaaaaagtaacattccagcaaaaccatgaacaaaaccctgaccagcagcatctccaaaatgataagtaactaaagttaataccataactctaatcacattagcggtaaaagaaattggaataatcaatatcccaagaattacattacgaataaatgaatcgtgctttacaacatttaaataaagtaaacccagcgcctccaaagatattaaagtgtgcaaaccagcacatgcatccgcaacaagtaattgatattgtccgatttggaggatcaccccacttcttgaaatcggatatcctatccaataaagtatattttctgctacatatgagaccgcaatcttcattggtaatgtcacagcatcaagaaaaactccaggaagaggcaccataaaaatcaagaagaataacggaaaccacaatgctcgaagcccagaataaccacggaaaattagcaacaatccagcaaaaacaggaatttgagatgcaatatctaacggtgcaatatcttgagaacggccaagaatgtagagtaaaagaccaaaaactaaaactatcccgccaattactggcctgcctataatattattttcggccttaaacaattggtgtctctgtacccatactaaatacaagacaacgccaacaattaatggtccatgagcttgatcttcagattgccatacagtatttaataagttcaaatatgtaggcgtatacataatgaacaaacctaataatagcatccaattccgattgattacctcccagataccaggattatcttgctcgattacctcgacagtgttcatatctacaaatcaaccaatattgacccaattaccttagtaccattattcttgcattgttctacagcaatagataaatcattcactcgagtatgattttgtcttgcaactaatacaattcctccaacagtaaaagcaattgcataaccatctgaataattactaagttcgggagtatccaataaaattacatcataaacacaagccaactctttaattaaatttccgaatgttggcttgctaacaagctcttgaggattaggaggtaatgtaccggcagttaatacagataagttttcaaaaaaatttatttttgaaattacatcataccccgctcttcctgctaagatatcagataacccacgtttgttactcagattgtatatctcatgctggcgtgggtagcgtaaattagcgtcaatcaataatgtattttcacccaattgcgcaaaaacaactgcaagatttgcaacaaaagagcttgcattatcgctgctgcttactgaagaaacagctagtgcttttcgttccggtgaaaaccaatgcagcattaattgactgcgtactgctctcaaaacctcagctttgttactaaaaggctgatatgcagcaacgagctcattaagatatgagttttggtcaggtgataaataaggatagttaaattgcctcgataaaacctgttgaatatcatcttcagttatcaaccctaatgcttgagcagcttctccaaagcgcaaacccttctctttatgtaaccgcataattctttcagcatcttcgggtgtaattttccccatccgcaataataaactaccaattgtaaattctgaaaattcgtttaccaatggtgcattttctactttttcagagtttgaattagaaggtgtaaatgaaatcataattcagccttccctaaagttatcaggtttgaagtatttttaaaaaatctcagttttcttttttctttactaatagtcccaagaagtggggcttgtaatacttcaattaagtcatcagcagtccgtactcttcgatcaacaaactcagctaaaactccaaaccctattcctaaaaacatacccaagaggattgacaatataatattcagcaataaatttgggctagtgggagtaagaggtgccacggcaggattcaataaagaaatatcagattgatttgactgaccttcaatattcgtttgagtatacctttgcatagccatgtcgtatgctttttgagcattttcaacctctcttgtcaaaacagataaaatatccctatctcgattaagttgtaatactttttctttttgattatttaaagccaaacgtatttccgcttcacgttgttgcagaattcttgaattacttgccacattacttgaaaccgatttgatctgtctatctagctcagacttaagattttcaatttctgctttagctcctagataaaaaggatggtttctttcaaatttctgcgaaacatctgcaaaccttgattctgctctagcaatttcagttttaagattttggataattggattagctgctacatcaggagactcataagcttcttttccacttgaatttttttcccgagatctcgcttccataacttgtgcttgtgcaataaccaattgagatgaaagctcatttaatctggctctttccacatccaatctttcatcaacacttacaatccctttctcttgctgatactctgaaagcttcgattgcgcttgagctagatcttctctcagttctttcaattgctcaacgaaatacaaagcagctttttgagaaggctcaactttaagttgtattgaagtttgcatataagactcagcaaattcgtttgcgattgtagctgcaaactggggatttaccccaaaaaagctaatatcaataatactactctctcgagatggtttaacttgaagtttttttagcaataaatctgcaagccattctttaatttcacctttacctgaagttgcttgataaaagtcctcttttacggctggaacatctgccagacctagtttatcaattaccttttttgcaacgtttttacttgaaataatatccacttgcgttgccatataacctggcattaactgcgcaggaagcattacacctgttacaggatcagcgcctttataattaacaagcactgaagctgttgctttataattttttggcaacaatattgtaacaatagcggtagttaataccgttataaataaagtaaaaataataattttatatctagctttaatgatagaaataaatctgataaaactcatcttagattacctttttgattattcagctgttattcaaaaaacaaactaaaatacactctcttgtacatatacaacatcattaggctgaataaaatcatcatgctttactttaattatcttaacaccaccttcatcatctaaccgtttcaccttaatacctttttccgttcccctgagactaaggccaccaccaacagcgagtgcttgcagcactgtcatatgatactcaagacgatattgtcctggccgctgaacctcaccatatatatagaatctaggagctcgatctacataaataatatctcctgccgtaagtaagatatttttatttaagtcgccatcccgcatcatttcagcaaaatcaattatctctctaacacttttcccctcaatcttgcgaaccaagctaatcaaatctcccccatcaggtgcaactccaccggccaacgccagtacgtctgcaagagattttgcactatccagtgggtagcgacctggcctgttaacctgacctagcacagaaacctgctgactctgcaactgagcaacaatgatattcacgtgagggtttttcaagaatccaccgctttccagcatgctggcaattttgcgttcagcagctgcaggtgtttctccaccgactctgacttcgcctatcaacgggtaggtgatagtgccagactcactcactcttacttccaaggaaagatcaggctgttcaaatacagatatccttagaacatcccccggcccaagaacaatatccgaatccgctgcgttaacattgaatacaacaatcgtcaggactaccgttacaaaccatttgatcaatttagtcatggcactacacctatacacgttttatagaattactactttagtccgcttactccgcgagcaatatcatcatcgacactagagggttttgactgttcggctttttctggttgttgtggtacttcggccgatttgtctaaatattcaatttttgcttcagcccgtagtcgcttgatttcagcctcacccgcttccttacgctttttattcaagagcatttgctcaatttgcggtgtcgcatctgccagtgataccgggctctcctttacgctatccatgagcaccagcatcgtcctcggtcccatgccgatcacaaacagctggccacgccttgcatccttcaggcgctcagaaatctgtggaggcagctctgccacactgcgggcaacttctccacggtcatattggattcccttagcatccaaccacgcagcgacttcctgcagggttttgaagctaccgagcgcagacttgaattcgtcattgacataacgtgaatcaatcaatatttgttccatttccaccagcttgcgctcggaaaatagttgagggttttgcttatagaaattctcaacttctgttttgtccggcttgcctatgttagccaccctagactggaggtatgcctgggcaatcatttgggattttgcgcgctcaatggcttgcatgacgttcgggtcccggtctacttttgctttcaaggcagcctgctccaacagttgacggtcaatcaatgattgcaatatctgcttggtagcagcttctttctgcgctggctggacattggcccgagcaagctcttcattgagttgatggacggttatttccttgccgttcactctcgccagcgattggctagcctttgtttcattagatttatctccacagcccgacagcccgatactaatcatcaaggcgaccaacgcccctttcgtcattttcgaccattgcattattgtgcttccatattcagtattcaaaatccagtctcctcaaaattcagccaacaccatcaatacgcattatcttttttaaacactaccagcaccgtccggatgatgatccagagatcgaacgccagcgaccaatgcctgagataatccaaatcatattcaatccgcgcttccattttttcgagggtatcggtttcacccctcaatccattcacctgggcccagccagtaattcccggcttcaccttgtggcgcaacatatagccacgtatgagcttgcggtattgttcattatgcgccacggcgtgaggcctcgggcctacgatactcattcgcccctgcaacacattgataaactgtggcaactcatcaagggaatttctcctgagaaaaccaccaatcggtgttaggcgctggtcacgcttttgtgcctgcaccactttgtcaccatcttccatcactgtcatggagcggaatttgtaaacaatgatttcctcaccattcaacccatacctacgctgcttgaatattaccgggcctttagaagtcagcttcacagccaaagccagtgtcagcatgatcggtgaaagcaacaacaggataagggatgcaagaataatgtcactagtccgtttgattaagctattaaaccctgtaaacggcgtttcacaaatcgccaccacaggcacacccgccacatcatcaaaccttgcctgcaccagatcaaaaatatagatatcgggcacaaaatagacagatgctgtcgtgtcttgcagctcctcaaacaactgtctgatgcgcggttgcgcggacatcggcagactgatgaaaatgatctgggtattgttggcacgcacataagccgccacgtccgccattgtgcctagcaacggtacatgacgcattcccttgggatgccgggatatctcgcgatcatcaaaaagacctttcacctccatgaacaggtaagggtcttcattgatgcgattcaccaaccggacaccgatatcattagcgcctactatgacaacagaacgaacttcgccatttttatgcaaatccgaggcaattttgcggatgagcaaatgcgcaacagtaaagatgatcggcaccgccacaaaccaggtatacaccatttcctcatggtactgatcagtaaggtctgcggcatatccgataaatgccaatatggtgacaacaattgcccatccgaacaaaatatcacgaatatagcccaacacttttccactacgccatgtgcggtaaagatccaggcgctcatagacatttgaagatacaaagtatgcaagcaacgcaaggattaagtagtagccattgaatggctcaccataaagaagcgtaaagccatacaaagtccccagaataattaaaggatctaacagctgcttgaaaaaagcgactaaaggtatgtcatttaccgtcatttatagctcttcaaaactcatattgccctgttactgagacactatttgacctaaattcaaacatatcagatgttgactctcgatcactatgaataaatgaagtagttatcctaaaagatgttactgggttatacataagtgacagcataaaactcttatctttatctgacctaaattgaccaaaaatttgatccccctcaaaatctcttttttcatatttcaatacgccttgaacagctatcttaccagttgcctgcaaattagccgttaatgatgttccacgattcagcgtataacttgttgtaacaaatgactgagcgttattttctctccaaactgcagcattcaaattggtttttccagaagtcatccaattaaagtttccccgagcattaacccccctaaagtcccgttgagacagttgctcatgctgcctatctaccaaaccaccaagaaactgcaaccttgactttccggtaacagcccaatcgacattcaactttaattcattctggtcataatcattgcttataaaagatccctgaaaagcttgctgcggctttgatcctttagtatttctgtacagaacaccgatgatacttttagtaggagatagatagtcaaatccgatctcctgtatatcttcctttagattagcggccctttgagcctcagccccgtactccatttcagagtaaataaaagcccctctaacacgccatctaggatgcagcatccaacgcgcctccaataagcggcggtcctgagttcttgtgtttaacgataacatggttccttgcagaggttggaattctgaaaaaggaaccaaagcttttttatgaaaaaactcaaccttgccttccaatcgatttcccaactcccaatcccacctggcaataacgtcacgaccatcattatctaactctgagtttttattaaatgtggacttgtttaatctaaaatccacatacattttttgacgactaatagtatgatccagcacaataccagcgcttttgacaagcattgtatctgaggtatctgaactcccagtactcatttgagctaattgcttactagcgaatcttcttaaattatcatcatatgaatatgtaagactggcatacggctttaaaacatccccctctaatgcacaagcagggactacaaatccagcaagctcgatacctagcccagcgaccaaagcaatttttattaggttagttgattgagataaccgcaaagaagtgtttccccaatgattaccagtaatgccagttaccggtatatatgatccaaagtcccaatatgccatttgtcaccgcatgagcgatgatcggcaaccatatttttccgctacgaatataaagcaagccgtatgccaagccagccactaaaccggcaaaccattcggtatgttctattgcaaacaatgcggatgaaactagtaaggccaggacgcttacctgccgagggtcgacattgaggaaatgttggttgtgaatccagcgcatcaagaatgaacgccagaacagctcttccatcaagggcacgaccaatgcggcccccatcactcttgtcgccatcagcagacgggcatccggtccgcttcccggatcgaacccttcggattgatcgccaatcaacatccatggcgcatccagattgatccaggcgataaatactagcataccaacggcgattgcgctcaaccacgacctggctcccagcgcggctagcccctggagctcgacatactgcttgcgtagataccaaagcaatagggcgaccagcccgaccttgatgccatagagccaacgcgtatcggcgtccaccaagccgatccggactaccaagtccaccactgccatgaagagcatatacaatgcaaatggcgctacacggctcaggatcggcgtatgtaaacgggataaaaacatatgttgcaaattgaattcaattggtcatcatacaaaactttggtcacaaatgacacaaattctcatttaggtagtctgttcggactaaaaaaaataagtcggcatcaagccgacttatcgaatgctactgagctactgcgatagatttatgacaaatccctgcttttacggcggcgcgccaccaatcccatcaaccccatgccgatcagcatcaatgcatattcggatggctcaggcacagcagccacacggaaaccgcttagccagatttcctgaaactggcggccgccttcgttgctggaagcgccctggatgatgcctatggcattgctgccaagttcaaacgtgtagcgggaggcatccacgc

SEQ ID NO: 174 - DNA, 26858 bp, Methylobacillus flagellatus
gcgtggatgcctcccgctacacgtttgaacttggcagcaatgccataggcatcatccagggcgcttccagcaacgaaggcggccgccagtttcaggaaatctggctaagcggtttccgtgtggctgctgtgcctgagccatccgaatatgcattgatgctgatcggcatggggttgatgggattggtggcgcgccgccgtaaaagcagggatttgtcataaatctatcgcagtagctcagtagcattcgataagtcggcttgatgccgacttattttttttagtccgaacagactacctaaatgagaatttgtgtcatttgtgaccaaagttttgtatgatgaccaattgaattcaatttgcaacatatgtttttatcccgtttacatacgccgatcctgagccgtgtagcgccatttgcattgtatatgctcttcatggcagtggtggacttggtagtccggatcggcttggtggacgccgatacgcgttggctctatggcatcaaggtcgggctggtcgccctattgctttggtatctacgcaagcagtatgtcgagctccaggggctagccgcgctgggagccaggtcgtggttgagcgcaatcgccgttggtatgctagtatttatcgcctggatcaatctggatgcgccatggatgttgattggcgatcaatccgaagggttcgatccgggaagcggaccggatgcccgtctgctgatggcgacaagagtgatgggggccgcattggtcgtgcccttgatggaagagctgttctggcgttcattcttgatgcgctggattcacaaccaacatttcctcaatgtcgaccctcggcaggtaagcgtcctggccttactagtttcatccgcattgtttgcaatagaacataccgaatggtttgccggtttagtggctggcttggcatacggcttgctttatattcgtagcggaaaaatatggttgccgatcatcgctcatgcggtgacaaatggcatattgggactttggatcatatataccggtaactggcattactggtaatcattggggaaacacttctttgcggttatctcaatcaactaacctaataaaaattgctttggtcgctgggctaggtatcgagcttgctggatttgtagtccctgcttgtgcattagagggggatgttttaaagccgtatgccagtcttacatattcatatgatgataatttaagaagattcgctagtaagcaattagctcaaatgagtactgggagttcagatacctcagatacaatgcttgtcaaaagcgctggtattgtgctggatcatactattagtcgtcaaaaaatgtatgtggattttagattaaacaagtccacatttaataaaaactcagagttagataatgatggtcgtgacgttattgccaggtgggattgggagttgggaaatcgattggaaggcaaggttgagttttttcataaaaaagctttggttcctttttcagaattccaacctctgcaaggaaccatgttatcgttaaacacaagaactcaggaccgccgcttattggaggcgcgttggatgctgcatcctagatggcgtgttagaggggcttttatttactctgaaatggagtacggggctgaggctcaaagggccgctaatctaaaggaagatatacaggagatcggatttgactatctatctcctactaaaagtatcatcggtgttctgtacagaaatactaaaggatcaaagccgcagcaagcttttcagggatcttttataagcaatgattatgaccagaatgaattaaagttgaatgtcgattgggctgttaccggaaagtcaaggttgcagtttcttggtggtttggtagataggcagcatgagcaactgtctcaacgggactttaggggggttaatgctcggggaaactttaattggatgacttctggaaaaaccaatttgaatgctgcagtttggagagaaaataacgctcagtcatttgttacaacaagttatacgctgaatcgtggaacatcattaacggctaatttgcaggcaactggtaagatagctgttcaaggcgtattgaaatatgaaaaaagagattttgagggggatcaaatttttggtcaatttaggtcagataaagataagagttttatgctgtcacttatgtataacccagtaacatcttttaggataactacttcatttattcatagtgatcgagagtcaacatctgatatgtttgaatttaggtcaaatagtgtctcagtaacagggcaatatgagttttgaagagctataaatgacggtaaatgacatacctttagtcgcttttttcaagcagctgttagatcctttaattattctggggactttgtatggctttacgcttctttatggtgagccattcaatggctactacttaatccttgcgttgcttgcatactttgtatcttcaaatgtctatgagcgcctggatctttaccgcacatggcgtagtggaaaagtgttgggctatattcgtgatattttgttcggatgggcaattgttgtcaccatattggcatttatcggatatgccgcagaccttactgatcagtaccatgaggaaatggtgtatacctggtttgtggcggtgccgatcatctttactgttgcgcatttgctcatccgcaaaattgcctcggatttgcataaaaatggcgaagttcgttctgttgtcatagtaggcgctaatgatatcggtgtccggttggtgaatcgcatcaatgaagacccttacctgttcatggaggtgaaaggtctttttgatgatcgcgagatatcccggcatcccaagggaatgcgtcatgtaccgttgctaggcacaatggcggacgtggcggcttatgtgcgtgccaacaatacccagatcattttcatcagtctgccgatgtccgcgcaaccgcgcatcagacagttgtttgaggagctgcaagacacgacagcatctgtctattttgtgcccgatatctatatttttgatctggtgcaggcaaggtttgatgatgtggcgggtgtgcctgtggtggcgatttgtgaaacgccgtttacagggtttaatagcttaatcaaacggactagtgacattattcttgcatcccttatcctgttgttgctttcaccgatcatgctgacactggctttggctgtgaagctgacttctaaaggcccggtaatattcaagcagcgtaggtatgggttgaatggtgaggaaatcattgtttacaaattccgctccatgacagtgatggaagatggtgacaaagtggtgcaggcacaaaagcgtgaccagcgcctaacaccgattggtggttttctcaggagaaattcccttgatgagttgccacagtttatcaatgtgttgcaggggcgaatgagtatcgtaggcccgaggcctcacgccgtggcgcataatgaacaataccgcaagctcatacgtggctatatgttgcgccacaaggtgaagccgggaattactggctgggcccaggtgaatggattgaggggtgaaaccgataccctcgaaaaaatggaagcgcggattgaatatgatttggattatctcaggcattggtcgctggcgttcgatctctggatcatcatccggacggtgctggtagtgtttaaaaaagataatgcgtattgatggtgttggctgaattttgaggagactggattttgaatactgaatatggaagcacaataatgcaatggtcgaaaatgacgaaaggggcgttggtcgccttgatgattagtatcgggctgtcgggctgtggagataaatctaatgaaacaaaggctagccaatcgctggcgagagtgaacggcaaggaaataaccgtccatcaactcaatgaagagcttgctcgggccaatgtccagccagcgcagaaagaagctgctaccaagcagatattgcaatcattgattgaccgtcaactgttggagcaggctgccttgaaagcaaaagtagaccgggacccgaacgtcatgcaagccattgagcgcgcaaaatcccaaatgattgcccaggcatacctccagtctagggtggctaacataggcaagccggacaaaacagaagttgagaatttctataagcaaaaccctcaactattttccgagcgcaagctggtggaaatggaacaaatattgattgattcacgttatgtcaatgacgaattcaagtctgcgctcggtagcttcaaaaccctgcaggaagtcgctgcgtggttggatgctaagggaatccaatatgaccgtggagaagttgcccgcagtgtggcagagctgcctccacagatttctgagcgcctgaaggatgcaaggcgtggccagctgtttgtgatcggcatgggaccgaggacgatgctggtgctcatggatagcgtaaaggagagcccggtatcactggcagatgcgacaccgcaaattgagcaaatgctcttgaataaaaagcgtaaggaagcgggtgaggctgaaatcaagcgactacgggctgaagcaaaaattgaatatttagacaaatcggccgaagtaccacaacaaccagaaaaagccgaacagtcaaaaccctctagtgtcgatgatgatattgctcgcggagtaagcggactaaagtagtaattctataaaacgtgtataggtgtagtgccatgactaaattgatcaaatggtttgtaacggtagtcctgacgattgttgtattcaatgttaacgcagcggattcggatattgttcttgggccgggggatgttctaaggatatctgtatttgaacagcctgatctttccttggaagtaagagtgagtgagtctggcactatcacctacccgttgataggcgaagtcagagtcggtggagaaacacctgcagctgctgaacgcaaaattgccagcatgctggaaagcggtggattcttgaaaaaccctcacgtgaatatcattgttgctcagttgcagagtcagcaggtttctgtgctaggtcaggttaacaggccaggtcgctacccactggatagtgcaaaatctcttgcagacgtactggcgttggccggtggagttgcacctgatgggggagatttgattagcttggttcgcaagattgaggggaaaagtgttagagagataattgattttgctgaaatgatgcgggatggcgacttaaataaaaatatcttacttacggcaggagatattatttatgtagatcgagctcctagattctatatatatggtgaggttcagcggccaggacaatatcgtcttgagtatcatatgacagtgctgcaagcactcgctgttggtggtggccttagtctcaggggaacggaaaaaggtattaaggtgaaacggttagatgatgaaggtggtgttaagataattaaagtaaagcatgatgattttattcagcctaatgatgttgtatatgtacaagagagtgtattttagtttgttttttgaataacagctgaataatcaaaaaggtaatctaagatgagttttatcagatttatttctatcattaaagctagatataaaattattatttttactttatttataacggtattaactaccgctattgttacaatattgttgccaaaaaattataaagcaacagcttcagtgcttgttaattataaaggcgctgatcctgtaacaggtgtaatgcttcctgcgcagttaatgccaggttatatggcaacgcaagtggatattatttcaagtaaaaacgttgcaaaaaaggtaattgataaactaggtctggcagatgttccagccgtaaaagaggacttttatcaagcaacttcaggtaaaggtgaaattaaagaatggcttgcagatttattgctaaaaaaacttcaagttaaaccatctcgagagagtagtattattgatattagcttttttggggtaaatccccagtttgcagctacaatcgcaaacgaatttgctgagtcttatatgcaaacttcaatacaacttaaagttgagccttctcaaaaagctgctttgtatttcgttgagcaattgaaagaactgagagaagatctagctcaagcgcaatcgaagctttcagagtatcagcaagagaaagggattgtaagtgttgatgaaagattggatgtggaaagagccagattaaatgagctttcatctcaattggttattgcacaagcacaagttatggaagcgagatctcgggaaaaaaattcaagtggaaaagaagcttatgagtctcctgatgtagcagctaatccaattatccaaaatcttaaaactgaaattgctagagcagaatcaaggtttgcagatgtttcgcagaaatttgaaagaaaccatcctttttatctaggagctaaagcagaaattgaaaatcttaagtctgagctagatagacagatcaaatcggtttcaagtaatgtggcaagtaattcaagaattctgcaacaacgtgaagcggaaatacgtttggctttaaataatcaaaaagaaaaagtattacaacttaatcgagatagggatattttatctgttttgacaagagaggttgaaaatgctcaaaaagcatacgacatggctatgcaaaggtatactcaaacgaatattgaaggtcagtcaaatcaatctgatatttctttattgaatcctgccgtggcacctcttactcccactagcccaaatttattgctgaatattatattgtcaatcctcttgggtatgtttttaggaatagggtttggagttttagctgagtttgttgatcgaagagtacggactgctgatgacttaattgaagtattacaagccccacttcttgggactattagtaaagaaaaaagaaaactgagattttttaaaaatacttcaaacctgataactttagggaaggctgaattatgatttcatttacaccttctaattcaaactctgaaaaagtagaaaatgcaccattggtaaacgaattttcagaatttacaattggtagtttattattgcggatggggaaaattacacccgaagatgctgaaagaattatgcggttacataaagagaagggtttgcgctttggagaagctgctcaagcattagggttgataactgaagatgatattcaacaggttttatcgaggcaatttaactatccttatttatcacctgaccaaaactcatatcttaatgagctcgttgctgcatatcagccttttagtaacaaagctgaggttttgagagcagtacgcagtcaattaatgctgcattggttttcaccggaacgaaaagcactagctgtttcttcagtaagcagcagcgataatgcaagctcttttgttgcaaatcttgcagttgtttttgcgcaattgggtgaaaatacattattgattgacgctaatttacgctacccacgccagcatgagatatacaatctgagtaacaaacgtgggttatctgatatcttagcaggaagagcggggtatgatgtaatttcaaaaataaatttttttgaaaacttatctgtattaactgccggtacattacctcctaatcctcaagagcttgttagcaagccaacattcggaaatttaattaaagagttggcttgtgtttatgatgtaattttattggatactcccgaacttagtaattattcagatggttatgcaattgcttttactgttggaggaattgtattagttgcaagacaaaatcatactcgagtgaatgatttatctattgctgtagaacaatgcaagaataatggtactaaggtaattgggtcaatattggttgatttgtagatatgaacactgtcgaggtaatcgagcaagataatcctggtatctgggaggtaatcaatcggaattggatgctattattaggtttgttcattatgtatacgcctacatatttgaacttattaaatactgtatggcaatctgaagatcaagctcatggaccattaattgttggcgttgtcttgtatttagtatgggtacagagacaccaattgtttaaggccgaaaataatattataggcaggccagtaattggcgggatagttttagtttttggtcttttactctacattcttggccgttctcaagatattgcaccgttagatattgcatctcaaattcctgtttttgctggattgttgctaattttccgtggttattctgggcttcgagcattgtggtttccgttattcttcttgatttttatggtgcctcttcctggagtttttcttgatgctgtgacattaccaatgaagattgcggtctcatatgtagcagaaaatatactttattggataggatatccgatttcaagaagtggggtgatcctccaaatcggacaatatcaattacttgttgcggatgcatgtgctggtttgcacactttaatatctttggaggcgctgggtttactttatttaaatgttgtaaagcacgattcatttattcgtaatgtaattcttgggatattgattattccaatttcttttaccgctaatgtgattagagttatggtattaactttagttacttatcattttggagatgctgctggtcagggttttgttcatggttttgctggaatgttactttttgtagtggctctaattttgataattagtgttgatacgctcctacaatatttggttaaaaaatggcagttaaaagcctaaactcttaataaggcctgtctaatggatggatttacactgcgaaatttaattatatttttactgttattggtagctactttaggaggagtaattcttaaacctactaagtttgttaatgcagcagaagatataaatttagaagcaatgattcctaaggagttcgatgagtggaaaatcgatcctacgattactcctatacaagtgagccctgaggtgcagcaaaacctcaataaagtttatgatcaaactctttctcggacctatattaataagcaaggaatgcgaataatgctttcgattgcttatgggggagaccaaagtcgcggcttgcaagcacataagcctgaaacctgctatacagctcaaggatttaatgttgatttgttgggtaatgccattttaaattttgatggatatgaaattaaagttagacatttattagcccagcatggggcacgatatgagccaatactttattggatgcgtgttggtgaaactacagtttatggtggattgggtcaaactataaaaaggtttgaattaggtttgcagggatatattcctgatggactgctttttagagtttcaagtattagcagagataatatctctgcttttacactgcaagaagaatttgttaaatctttactgaaaaatgtagatagtaaaagtagaaaaaaacttataggtacattttcataaaattcaatgtttttttaacctaactttaataataaaaatgtagcaatttatgattaaacataccgcatttatggctctttcgactttttcacggttgctatcagcggttgtacttttcattattcttgcaagattccttggtccgagagactttggcatattgatgtacaattttactcttgcgtcaatagctgtgcttttagtggaatatggattttcaaatcagttgttaagagatataggaagataccctgataatattaatcagttaatggggagggtttttcttgcaaaactatatctcacagtagtgatgggggtctgttgccttgctggacattacttattctatacaaatgacttagatagagcaatattttggattttactgttatcttgtttgctcacttcttttggggatttttttaatattgcattcagaggtatcggaaaatttcatgaagaaacaaaagttgcaacaattggctctttgttgcatttcggcttaatagttttaatggtaattaatggggctgagttattattaattagtttaggttttgttttatctcgttttgtttattttattttgtcgtggcgggcatataagcgagtggttggtgatttaaatactctgtcagcctctccagttgctgttctaaaagcattaaaagcaggatttccatatgccgttgatgcgggtttcactaactttttctaccaagttgacaccatgcttgtgaaatattatctgggagccactggagttggtatttaccaagcaggtatgagatttctaaatggtgcaatgcaatttgcacctgtactcggaaatgtatttttacctgtaattgctgccaagcacactaatactagagagtttgttgagctagctaaaaaacttaatcttcagatgcttgctgttggtactgtgtgctgggctattttctggtttgccggtatgcatattaccgaatttgtttttggtgatgaatatgtagagttaaattcaatttggccctatattggtttgttagtttttacaagatatcttgctgcgcctcaaggtgttctattgactgcttctggatctcagacaatacgtgtctgggcacaaatttttgcacttattattttgctaatttcagcaccacttctgatgaaagtgattggactaaaaggtatggtcattgctttaatcatcacattattaaccttgtttttgatatttttcagtgcattacggcttagaaaaatacctactgggtttgggggagttaattttactttgactgtaatagtatttagtctttccatttttcttttggtatattagtcatgttgaaaataggcttactttggcattctactacttcagataatcttggtgttggcgctttaactgaagcacaaatttctattattaataaagctgcggtgcaggcgggggttgaggttgaatatcgaattttcggcactaatggaaacaaagattactttgagggcaaccctttaattgagcgagggacaaatgtatcactcaaaagaattttgatcggggcttctgattatcccaagaaaatccgggaatgcgatgtggtgtttgatataggtgaaggtgatagttttgctgatatttatggtttttcacgattcctaatacagattgtgtctaagttggttgtcttgtttcaacgtaaacctcttattttaagcccgcaaactatagggccattcgaaagtaggtttaatttaaaggtggccaataatgtaatgcagcggtgcactaaaatatttgtaagggatggattgtcatttggatacttgcaaaagaataatttatctgtaaatgcagaggaggtaattgacgttgcttttagattgccatttcaacgcccttcccgggattcaagtaaagtaaaaattggactaaatgtatcaggattactttataacggtgggtatactgggaagaatcaattcggtcttagtgttaattatcctgaacttactagatcactattagatcagtttactcgaatagaaggttgtgaagtatggcttgttcctcatgtgctaacgacctcatttcctatagaagacgatgtgaacgtgtgtgttcaattacaagagctttatccagctgctaagcttgcaccatctttttcttctcctagccaagctaaatcttttatttcagggatggatttttttcttggagctcgcatgcatgcttgtatcgcagcattttcaagtggagtgcctgttgtgccattagcgtatagtaggaagtttaatgggcttttttctgccttggattatccttatcttggggattgtaaggttaatactaacgagcaaatagttggtttggttatggattgttttaacagtcgggagcagttgaagtttgcagtagaagaaggtaataaaattgcagaaaaaaaactattgcgttatgagcagtacatagcagaattattaactagaatttcaaataaaaagattgttttataagttaaaagtcaaatttactaagttgaacacatattttagagaatgtatagttgtaagatgaaaaaatacataattggtttcttgccgctttctattaaatggcttctgagattttgtcttcgaggcccgagtttattgagagacttttgttacgatgctaaacgatatattaaatggtcatctgtaatttctttcgagaaagatcgtgaaaagattcttgcggttattactgctacttatcacaacatcgagaaaggaatgtctttacctaatcccaggccgttatttggaagggtagtgattggacaattagttggatcagtcgataattttcatcttaattttgggcctgatccacagctagatgttccgataaatgtactggcgcgttattgtcaatttaatagaagtcttggtcagccagattctcaattagaagtaatcgttgatcggttaaagaaaaataatcagagcactttattaaggattaatgatggcggggttattttgcgctctaaagctgaggttttagacgcaatatctggggttaaagaagatttttttcttatgcgccatagtgtaaggcagttcactaaagatcctatagagcatagtgtaattgaaaaggccgtacgtattgctcaaaaaagtccagcagtttgtaatcgacagtctggaaaggtccgggcaattcttaatccagaattaattaggagtactttacaaattcaagggggcgcacgagggttttatgaagaggttcaggctttattttgtataacagtggatttgtcaaattttaatggggcggaacgttatcaaggttggattgatgggggaatgtttgcaatgagttttatatatggcttacatttgcaaggcctaggaagttgcgctcttaactggagtaaaactaggaaacaagatatagaaatgaggaatcaccttcgtataccagaaaacgaattaattatcatgtttgttgccgctggatatttaagggaatcatttgttgttccgcaatcataccgaaaacctttaggtgaagtcttgagttatatttaatatatattaaatattaggtagaaggtaccattaaaatttcacaaggctaatgcgtcattatgaagaacaattcttctctcttatcttttaaccgtagggatgctaatttcgttagtttaaagatagggagtatattttttgtaataatggctgcaatagtggctttgatatttggttttgtcagtgctatttttccatggtggtggatagtagccattattctttctatattatttatttttattggttttacatatcctttagtagctttaatagctgttatagcaatttcttctagattaattccagatacatttttgccttcaataagactgctgggaggcacaataccatcttcagatatggccttgtttgcaacattcattttttgtttttttaaatacaattcagaatttagctttacaaagcaagcattgtcacctttggctattcctttatttgttgtacttttactgttgcttttttctgtatttcgggcggtgtttgaaattagattgccattgaaagatattttaggggagtcaaggcatttcctttattggctattgattcccttaatagctttaacatgctcagatagacaaagatttaaatttattgtttttggctttctttttgtagcttttttattttcaattggccagattttgcaaggttttctaggtgtaaatgtgttcgggcgcgagcttactagccttgaaactttgggaagcattaatagtgatgttacacgaagcatgacgtcaggaactcacattattgtttggggatttttgtttgtactggctttgtttgctaaccgaataggtttttcaaagactcttattatattgtgtatatttacaggcgctggaattttcttaacctatggtcgtgctgtttggggggggactttcttagctgttttgttcttatgctggaagctagggacaaaaaaaatgcttagaagtgtaggactaattgcaattgttgctgtatttggtttaagtgctatgctagctattaagccgggcgctattgaaggcgcgatgcagagattgtttagtgtggaggaggaggtttctcatggatcttctctcggctggaggttttatgaaaataaaatggcatgggcggcaattcagcggtcacctttattaggcattgggcttggtgccccttataggccgcctgctaaatctgatgtgacagcagagcaagtgagatatgttcatagtgcttatatctatttaaccttaaaaacaggcattattgtattcatgtcagtcatttttcttatattcaaaatacttcatttaacttacattcaaacgcggtctaatgatttatttatatcaagtgttgccatagcttcttttgctgcaatgatagagtattttttggcctgcattactcagccagaattaatgcaaaccccgggaattgcttttttggctactcttgctggtcttatgtgcgcggctaattatcttaatcaaaaaaatcttacaaaaggaaagctaacttcttaaagtgtaaattggaatatatatatagtcataattatataaaataatatgagaacttaaagatgaatgttaaaacatctccattaattagtattattacggcaacatataattcaatgaaatattttgaggatactaaaaaaagtgtccttgaaggagatgttgaagactttgagtggattatcgttgatgatggatccactgatggaacgcggaaatatttacaagaaattgatcatccaaatataaaattgcattttaaaagtattaatgctggtattgaagactcatatagaactggtattgaattggcgaccggtaaatatttgctaattttagatcacgatgacactattccattgggatctttgtcaaagcggcttgacttactggaatcaaatcccaatgctttggctgcatttggtgctgtggcatatatggatgagtctgggaggatttataaagaatcacgttttccttttgtatcagatgattgcgtactgtcatcactatttactttattcggaatctttattttaccagtataccctttaaagcaagggtgtgtggttttgaggtcttctttcgttaaaaataatccagggttatatgacatacaactattcctgcaagctgctaaattgggcccagtaatatttatcaagcaagcatgtttaaattatcgaacatttagaacgcagttttcaagttctagaaaaatgcgattgattcgtttttttcaatttgtttgggcaaaatatgcgtttaaatttctcccgtggtatataagcccgttctttgctatttataaaacaataccagagttctttaaagtattatggagttttgtttcttcaaaacggatttaaaaatatgttaacgattctttattcatggttgcaatttttattggtgcttattgatgacggattttagttcaaaaaaaaagttagacttaagtgttgcaatagtttttgttaattataatactagtgaccaaattatttcttgtatttactctcttagggaagagagatattcaaagattattgttgtggataatgcatctccggatgattgtcctgagtgcatcgtagaagagtttccagatgttgtacttattaaaagtgaaaaaaatcttggctttggtgagggatgcaatattggaaaagattgggttatagttaatacagattgtgaatatatattttttcttaatccagacacactagttgaacctggattattacaattactgcatgatggattttttagccctgaagttggattggttaccccaagaattactatgatgggtgatgggttggatatactttggtatggtggggggtatatgaactggttaactggttcggcacgcgtaccaggttgtggattaagtgctgtatcaaaaatagctctagaagatcgatttgtagagtttgccagtggttgcgcttttatgattagacgttcagttttagaagagtgtggcgggttcgatccacgctattttatgtacgaagaagacgtcgaattatctttaagagtaatttcttatggatataaaatttattatatgccaaaagctgttgttcgccatctggctcagggtagccagggcaaagaggtagaggctgttggtatgtttaaaggaaggaatcctaagcttcctttttttgtttatcaaactgcgaaaaatagatttttaactgtttttactcatggaactgtgcttaagaaaggtctatttttaataggttttatgttatgggtgtttcgaaactcttttgaatgggtcagatataagagacttgatgcatataatgctttatttttgggcattaaagattttgttaaatacacatatgtatcaggtaaaaaataattattcagattgggtgttatgtgaaagaaattaacgtcgcctttgtggagccagttggtagtcacggtggtatggactattatgattctggactgtgtgccggtttgttacatcagggagtatctgcaacttggtatacctgtgacatttctaaaccttgtggtaatagacctattttcatgcaacttacttttgtaaatatttggggaaaggatgctacgtggagaagaggggctaggtatatcttagggctttgtaggagcataaagcatgctaaaaaaaattattcaaatattgcccattttcatttttttcatgtgggtgttttagaatttttaagtgtattattttttcgcttatttggatttaaggttgttgctacagtgcacgatgttgagtcttttaagccgggtctaaccttctctatcttgttaaaatggacttactttctctgtaatcaattaattgtgcacaatcaagttagtaaggatgagttgattaatagaagtaatgtttctataaataaaatacatgtaattcctcacggaagttatattggtctggttgcaccctcgatgccaaaagcagatgctcgtcaagctcttaatgtatcatcagatgaaaaggtaattttattttttggtcaaatcaaagaagtaaaaggtttggatttgttgattgaagcgttaggtttggttaaagataaactaaaaccatttaagctagtcattgctggaaaagtgtggaaagataatttctctaagtatcaagaattaataagtaaaaacgggctaaatgatttttgtaaattggatattagatacataccagatcaagagatatcaatgttttatagtgcggcagacttgattgttctgccttatagaaaaatatatcaaagtggtgttttattaatggcaatgagttatggaactccagtgttagcttcagaccttccgggtatggcgcaaattataaatgatggggaaaacggatttttgttttctgctggaaattatattgatcttgctgaaaagcttgtaaaaattttttcttaccatgacttatctaggattactttgcaagcagaaaacgatatgagaactcgcttcagttgggatgagattgcgataaaaactatcagtgtttatcagaaaagtatatcgtaatgtgtatttgctaagattatggtaaacgggtttgatctaaaaatattttgcggtgatgtttagtaaaattcttaatggggttaggattcttgattttttcatcttctgaattgtgatgtcagtaaataggctcttttgtatgttatatttatttggattattttccattgctatagcttgatagtgattatctttgactttaataaggtatgagttttttaatttaacttcgggagtaatctttatatattaatttttataggtgtcaattgtaaaaaataaattttaaagctaataataaaattagctaaataattagattattttgccgttaataataggtgtggatttttatttacagtgtttttttgaagtggcgtgatttgatcgtatctagcctggaggtccataactatgcaattaattaactctcgaaggattgttttacttagtttgttttcccttatgcctttggttggtattgctgaagtttataaatctacagatgtagacgggagtaccacttattctgatacccctcaagctaattcacaaaagataaaggtttttccttctgattataagaagaatgttaaatctgaggctgcagctaataaatccagaagtaattctatttctgctgctaatgttacagaagctcctattgatgagtctagtagtgattctaatgtaactataaagcattcaacatctaataaatctatcaattcaagcaatccttctgctgctggtggctcttcttctgctggtggctcttcttctgctggtggctcttcttctgctggtggctcttcttctgctggtggctcttcttctgctggtggctcttcttctgctggtggctcttcttctgctggtggctcttcttctgctggtggctcttcttctgaaacaactacagctgcttcggtcgataaggtttctgcggctttgcaaggaccgaaagcttttcttaattcagacgattttaaagaaaattcttatcgagggtttaatgttcttgggcggaaattaagttctgctgacatggaagatcttgaaaagtttaacgtcaatttaattcgaagcgttattcatttggaaaaatgtaaaaaatgtaatgattatgaaatttctccagttgagttgtcgcaaatggattttcttgtggaggcaggtcgtaagttgggattttatgtaatttttgcttttgatcctaaacctgctggagatcaggcgatctactggaataatcaacaattacgagaaagcattaagaataactgggtaactattgctaaaagatacaaaaatgagactgtggtggcagggtttgacctgattaatgagcctgttgttaggcctggatcagtatgggaaaagtatgctactgaattgattactgccatacgtaaagtagatgaaaatcatataatttttctggaacctagtccttgggggctggcttctagtttggagcagtttactcctgttccatttaataatatagtttacagctttcatttttattctccccaagaacttactcatcaaggattggcggcatacccacatgcatatatatatcccagtgaaaagtgggataaagaatacctaaataatcgactagacattgctcgtaattgggctaataaatataatgttcctctttatatcggtgaatttagcattattcggtgggctccgtctggttcgaggttacgttacttgacagatgtagttgagcgctttgagcaagagaaatggtcatggacatatcatagctatagagaatatagcggatgggatgcggaaatgccagatagtatattcaagaatgatgctattgtcgaacgtcaaaacaatgttcctgtacttcagcttttgatgaaaaattttaataaaaataagaaatattagaatcacatttaacatgagtttgtatttgtatgcataagaaaatagcaatattaggaaccagaggaattccggctgcgcatggtggctttgaaacatttgcagagcatttggctatttatcttgaaagaaaagggtggaaagtaacagtttattgccaagtagatggtaatgggcctatgtatgaggatatgtggaatggtataaagcgagtaaatattccgatatctatccagggttctttaggcactattctttttgattggaagtcaacgattcatgcttcaaatacttatcatcttattttaactcttgggtataacactgctttattctgtgggctctatagaactaaaggaataactaatctaattaatatggatggaatcgagtggcatcggaaaaaatggggggcagttgctaaactctggttctggattaatgattgggctggttcaattttaggcaatcatctgattgctgatcatccgcaaattgcgcgtcatctggaaacaagagtcaggcctagcaagatcacaatgattccatacggcgcagataaagtgattgaggcgaatcaggccgttttggaggaatatggacttaagcctttcagttatgcgatcttaattgctcgtgcagagcctgaaaattctattttagaggtggtgaaagcctggtccgctaaacctcgaggcatgaggcttgtagtgctaggaaaatataaccctgaccatgcttatcaggtcgcggttaaagctgccggctcagacgaggtgctttttcctggcgcaatttatgataaacacgtggtcgaatctttacggtatttctcaagattatatattcacggccaccaagttggcggcaccaatccttctttggtggaggcactaggggctggtaatgcagtattggcgcacgataaccgttttaaccgctgggtcgctggagataaggcggcctacttttctggtgaaaaggactgcgaaatcactcttgatgagcttcttaatgatgaagttcggttacgtgagatgagagccggtagcttggctcaatacgataccttatttacctgggactcagtgttgcagcaatatgaggccttgctgacaaggtttttgccaaataagtaattagatactgtgcctatttctttccctttatatttctatccagtgagaaaattatgcagattcaagccgtgattttatcaggtggctctggcacaaggttgtggcctctttctcgagaaaactatcccaagcaattgctgacattgcttgataatgattctttacttcagtcgacattacgcagggtcgatccactcattggaaccgagtgttctccaattctggtatgtaatgaagaatatcgctttgttatcgctgagcaattgcggatgatgggaaggcgtggatctattctccttgagcctgtaggcaagaacactgcccctgcgctcaccttggctgccttagaggctgccagccacggccaggatccaatcttacttgtcatgcccgccgatcacgctattatcaatgtgcaagactttcaggataccgtgaggacaggggctgaacatgccgctgctggtaagatcgtcaccttcggtatcgtgcccgatagggcagaaactggctatggttatatcaagtcaggcgcagtgctggaaggtttcggttctgctttcagtattgagcagtttgttgagaagcctgatgaggctactgctcagcaatatgtagtaagtgggaattatttctggaacagcggtctgttcatgatgcgtgccacggtatggctgaatgcgattgctaagactcgtccagatatcttatcttcatgtaagcaggcttgggatggtcaacaacgcgatggcgattttgttcgggtggacaagcttaaatttcaacaggtacctagcgattctatagactatgcggtgatggagcatgtcgctcgtggtgccgataatctgcctgcaggcatagtcatccccctgaatgccggctggtcagatgttggggcctgggattcattcgggaaaattttgccgcaggataacgcgggtaactcccatttaggagatgtgctgttcaatgattgctcgaatactctagctgtgtcttcaggtaggctgcttgcatgtgtgggtctgcaaaacatcgcggtgattgagacagcagatgcggtgctagttatagataaaagtaaaactcaggatgtgaaaaaaatcgtggagcagcttaaggtccagaaaaggcccgaggccaagactcaccgcaaggttcaccgcccctggggctggtatgacagtattgatatgggggcacggttccaagtaaaacgtattgtagtgaatccaggtgctacgttatctcttcaaatgcatcaccatagagccgagcactggattgtggtgaccggtacagcgaaggtaacaagaggagatgaggagttccttgtttctgaaaaccagtctacttatattcctttaggtgtgacgcatatgctggctaatccaggaaagcttcctttagaaatgatagaggttcagtctggggcttatttgggtgaagatgatattgttcgcttcaatgatcaatatggacgttcatgaataatttcccttggtctgactgaagtcagttttaatgattaattagtaataatgctaatgattttcgaccgagaatgttgctaagtgggttactgtagatcgcaaagccaattcccatggtgctaattcagttttgaaagtgctcatgaatttttcagtgctcatcttggagttggcggggcgatgagctggtgtggggtattctgcagttgtaataccgacaacattttctacagtggattttaatttcgctaaatttttcttttgggctatttctccatactggcgaatgatttccagtgcaaagccatgccagctcgtctccccagtattgactaagtgatagacacctctttgagtcccatcccatgcgtgcagcgcagtaatagttgcatctgcaatgctttcggtagaagttggtgcgccaaactggtctgcgactatattcaatgagtcacgctcggcagctaatctcaatatggtgcgcatgaaattttttccatatgcaccataaacccagctggtcctgaagattagatgatttgctccgacttcttgaatggctttttctcctgctaacttgctggctccataaacgctaagtggatttgtttcatccaattctgtgtaaggggtagttttggtgccatcaaatacataatccgtagaataatgcacaagcaatgcatttagctttgctgcttcttcagccagaatgccgggagcagtgccattgatggcgtaggccagctccggctcagattccgctttatccacagcagtataagctgcagggttgattatgaggtctggtttggtctgtcgcactacgtcccggatatggtcaggtttggataggtcaagttggctgcggtcaagtgcaacgacttctcccaagctttgtagtttcggatagagagcatggcctacctggccgttgatgccggtaagcaggatcttgttgaaagttgccattatgcgaataactctgtctggtggaggcctaagccttgttgatctttacttgagaggagcgggggcgtgccaatatctggccattcaataccaacaacgggatcgttccagcttaggcaacgttcatgcgcaggcgcgtagaagtctgtggtcttatagagaaactctgcagtttcggacagcacgaggaagccgtgggcaaaacctggtggtacccacatttgtttcttgttttctgctgacagatgttgccctacccattgaccaaaggttggagaagatttgcggatatccacggcaacgtcaaaaacttcacctgctactactctaaccaattttccttgggcttgctggatctgataatgtagccctctcaatactccttttgaggattttgagtggttgtcttgtacaaaatcatatttcctgccgacggcttcctcaaaggctttctgattgaagctttcaaaaaagaatccccgggcatcaccgaatatcttgggttcgaatacgatcacatcaggaatatgggtgggcgtgacattcattaaaagaccttttctttcagcatccggatcaaatattggccgtaaccattcttgaggtatggctgggcaattttttctacttgttctgcatcgatgtaacctttgcggtaagcgatttcttcggggcaggcgactttcaggccttgtcgcttttctatggtttcgatgaatagtgaggcttctagcagggattcatgcgttcctgtatccaaccaggcatgaccgcgccccatcaattccacattgagggagcgcctttccaggtaaattttgttgacatcggtaatttcaagttcgcctcgaggagatggtttgaggctggcggcaatgtcaacgacctggttgtcatagaaatacagtccagtaacggcatagcgggattttggctctttgggcttttcttccaggctgatagcctggccagcatcgttgaactcgaccacgccataacgttcagggtcgtgaacagggtaggcaaatacagtggcgccatgctgccgttgatcggcatgtgccaggtcatgtgccaggtcatgaccatagaagatgttgtcgccaagcaccagggcacttggatcattgccaataaatttcttgccgatgataaaggcttgggccaatccatctggggagggctgtactgcataggcaatattgagtccccattgactgccatcacccaatagctgttcaaagcgtggtgtgtcctgcggagttgagatcaggaggatgtcgcgtatcccagccagcatgagcgtggacaagggatagtagatcatgggcttgtcatacacgggcagcagttgcttggagactgcctgggtgacagggtaaagccgggtgcccgatccaccggcgaggatgatgccttttctcatgctgcgctcccgctatattgcttgctgacccagttgcggtattctccactggtgacgttgtgcacccatgcctggttttgcagataccattccacggtttttctgatgcctgactcgaaggtttccgcaggcttccagcccaactcgcgctccagtttgcttgcatcgattgcgtagcgccggtcatggcctggacggtccttgacgaatgtgatttggtctttgtagcttgagccatctgccttggggctgagttcatccaggatgctgcataaggtctgtactacatcgagattggccttttcgttccaaccgcccacattgtaggtttccccgagctggcctgcttccagtacgcggcggatggcgctgcaatgatccttgacgaatagccagtcgcggatttgctggccgtcaccgtaaataggcaatggtttaccagcaagcgcattgagcaggcatagtggaatcaatttttcagggaaatggtaaggcccatagttattggagcagttggtggtcaataccggcaagccataagtgtggtggtaggcacgcactagatgatccgaggctgccttggaagccgagtatggactattgggggcgtaaggggtggtttccgtaaacgcttggtccttggggcccagtgtgccatacacctcatctgtagagacgtgcaggaagcggaactgaggattttctttttcctctgggtgggttttcaccacgctattccagtaggcgcgtacttcttccagtaagtggaaggtgccgactacattggtctgaatgaagtcttccgggccatggatggaacggtcaacatggctttcggcggcaaagttgatgactgcacggggtttgtgttctgccagcaacttggcgaccaaggcgcggtcaccaatatcgccatgtacgaagatgtggttggggttgccttcaatgtctgccaggttttcaagatttccggcataggtcaatttgtccaggttgatgacggtgcctagtcctgccttgacccagtcgagtacgaagttgccaccgatgaagcctgcgccaccagtgacaatgatagtgttatttaatgtcgtcaatctattaactcacttaatatctggattatttgcgggtgtggtgaaattattatttactggtttatattacaagaaggctatcacagaatggtagcttaactttctaattcagatttttttaaaagttttctatgtttataaagctactataaatatgtgtggcgcttcaatagggctattggactaaaggaaaagtttttaatgttattagtaacaggcggtacaggctacataggttcccacgcatgtgtggaactgattaatgcgggctatgaggtggtggtgctggataatttcagcaatagccaggcgcatatcgttgaccgcatcaagcagatcacgggcaaggcacccgtattggtggaaggggatgtgcgggatgaagcactactgagtgatttattttctaggtacccattccaggcagtcatgcattttgccgggctcaaggcggtgggggagtcggtcgcgcagcctttgcgttattacgataacaatgtggcgggtagtgttaccttgctgcgcgtcatgcaggcgcatgacgtcaaacgattagtcttcagttcgtccgctactgtgtatggcgatccagccagtgtgccgattcgcgaggatttcccgttgtctgcgaccaatccttatggggcaagcaagctgatggtggaggatatcctgcgcgacttggcagtctccgatccagagtggcgtattgccatcctgcgttatttcaatcctgtgggcgcgcatgagagcggcctcattggtgagaacccgaatggtatgcccaataacctcatgccatacatcacccaggtagcccaggggcagcgtgaatctctttctgtgtttggcagtgactatccaaccgtggatggtacgggcgtgcgcgactacatccatgtggtcgacctggtggttggccatttgcgtgccctggagcggctggataaggaagctggtgtgttcacatgcaatcttggcacgggccaaggatatagcgtgctggaaatggtcaaggcatttgaagacgccagtggccaggctgttccctatcagctggtggcacgccggccgggtgatgtggcggccagttataccgatcctgcttatgccgagcaggcattgggttggaaagcgacgcgtggcatcgagcagatgtgcaaggatagttggcattggcagcaaaaccttgcccagagaggctga

SEQ ID NO: 175 - DNA, 13733 bp, Methylobacillus flagellatus
gtgaggagactccttgatgaacgtagtttaaacatactcttgtaatccaagagtttaacttgggatgagatattctgaattggttgaagcgtaatcttttaaaatttttgggatgtgtgttatttagtattatgatttttatgatgtttttttattgttaaatattgtttttagtagcaatattttttatataattagatttcatattgaatgctcaagatttaatttaattcagtatttaaaactctttaggtataatgagccaattttataaaaaagttttttaatgctgcttcctgtcattatgtctggcggggccggttccagattatggccggtttctcgtgaaactctaactaagccatttatcgaattacctgatggcagaacccttctgcagaagactttgcaacgtactgcttgcctggatggtgtgagcgaagtgctcacagtaacgaataaggaatattacttcctgacacgtgatgtctatgaggcaacagacactaatgtttcccatagctacttactagagacgatagggcgcaatactgctcctgccattgcagttgctgcactacatgccgctgcgaaacatggggaagatgtagtgctgttggtgatgccggcagatcatcttattggtaatcaaaaagttttttcaaaagcagtgactgttgcgacagatatggcggtgaatggctggatagtcacgtttggtgtagagccaagcacgcctgaaacaggttatggctacattgaaggcggagagtcaattggggactcaggcgcgcgtagagtcgttcgatttgtcgaaaagccagatttggaaactgctgagaaatatattgctttaggtcgatttacatggaatgcaggtatattctgttttactgcaaaaaccattattgctgcacttgcggagtatgttccagaagtgcttgagatagcaaaaaagaccctggcatctagtgactccaaaactgagcctgttgtattgggcgaggagcactttgcatcaagtccagatatttccatagattatgccgtcatggagcgtgcttcaaaagtggcggtagtcgcagctgattttgactggagcgacattggttcatggagcgccatggctgagttggtccagtcagatgagcgtgggaatagggtgaatggcgaagctttattggtggatgctaataattgctatatccaaagtgattcccgtcttgtggctggtataggtattgataacctgctggtggtcgatacacccgatgccctgcttgtggctcatcactccagagctcaggatgtcaaaaccgttgtgaagcaactcaagcttgagtcccatagtgcggcaaattaccatcgcaaggtacaccgtccatggggcacatacaccgtattggaagaaggcgctaattttaagatcaaatgcatcaaggtaaagcctggtgccagcctgagcttgcaaatgcaccatcatcgtagtgagcattgggttgtagtaagcggtatagctaaagttgtcaacggcgagcgcgagctgctcattaatgccaatgagtctacttacattccagcaggacacaaacaccgtcttgaaaatccaggtttgcttgacctggtgattattgaagttcaatccggggaatatttgggcgaagacgatattgttcgttttcaagatatctacggacgcacttgatgatcagcatgttaaaagccttatggctttatcgcggctttgtgttgggcagcgtcaagcgcgagtttcaatccaagtaccgtaattcgctgctaggcgcagtctggacggtcttgaaccccctcgcaatgatcgtagtgtacacagtgattttctcgcaggtaatgaaggctcgtttgcctggcgtggacagtacttttgcgtttagcattcatttatgcgctggcatactcacctggggcttgtttgctgagattgtcgggcgctcacagaccacgttcatcgataatgccaacttgctcaagaaactgagtttcccccgtctatgtctgccagtcatcgtcaccgccaccgcgctagttaactttgccattgtttttgggttgttcacagcgttcttgctgctgatcggtatgttttcgggttggccttatttggtgctgatcccggtattgatactgatgatcgtctttgctctaggcttgggtattatattgggcgttctcaatgtgtttttccgcgatgtaggtcagttctttggcattgtgcttagtttctggttttggcttacgccgattgtctatccggtcagcattcttccagaacgggtacaagattatatgcggcttaaccccatggcgcgcttgatggaggctttccaaggaatattggtacaagcaaaatggccggactggtacagtctatggccagtgtttgcgctgtctatcgtgttgtgcctgctggggctgtctttattccgcaaacatgcgggcgatatggtggatgaactttaatgggtactattgttgtcaccaacctgggtaaggcctacaagcaataccccagtcgctggtctcggttgttggagtggatagatctgaggcgtaagccgcaccaccaattgaagtggattctgcaaggagtaagttttcatatccagccaggagagacggaggcagctttgccgtgactgctgccaagcgttctaatacgagtattaagcctaaccttgcagtgatcaattggatgcttgagcaagaagaccggatgggattatctaccccaaggccttatcgtgaatttgaggagcgtgtatatcgtcatcgcgatgatctcaggcgcttaattcattcgttagtagctgacggcaaaaaaatatatgggtatggagcttctgccaaaggtaatgtagtactacaattttgtggctttacttctgaggaaatccctgccattgcagaagtaaacgaagaaaaattcggacgagtcactccgggaacgcatattcccattatttcggaaaaagaggcgcgcgctgccaagcccgactacttcttggtgcttccatggcatttcaaagatggtatcctgcgccgtgaaaaggactttctagctgatggcggcaggtttatcttcccatttcctgagatcgaaatcgtctagtttccaaaaaaagatgaaggaaaataataagataatttagacgctgttctaacgaatccattatttacataccatatatacatatacagtaagactttaaatacataaggcataatacgatgaccataaaaactgccatcattaccggcatcacaggccaagatggtgcatatctcgcagaacttctccttagtaaaggctataaggtttacggtaccttccgccgtacaagctcggtcaacttctggcgtattgaagagctgggaattgaaaatgacccaaatcttcttttggttgaatacgacctgaccgatttgtcagcaagcatccgtctattgcagagcacaggtgcaacagaagtgtacaacttagctgcgcaaagttttgtgggcgtgtcttttgagcaacctattactaccgcggagatcacaggtgtcggtgcgctcaatcttttggaggccattcgtttagtaaatcccaatattcgctattaccaagcatccacatccgaaatgttcggcaaggtgcaggcgattccacaaacggaagatacgcctttctatccacgcagtccttatggtgtcgccaagctgtatgcgcactggatgactgttaactatcgtgaaagctatggaatcttcggatctagcggtattttattcaatcatgagagtccgttgcgtggtcgcgagttcgtgacgcgcaagatcacggattcggtggccaagatcaagctggggaaacttgattgcctggagttgggtaacttggatgcaaagcgtgattggggctatgccaaggattatgtggaaggcatgtggcgcatcctgcaggcggatgagccggatacctttgtactggcgaccaatcgtaccgagactgtgcgcgattttgtaagcatggcgttcaagggggctggcattgctgttgagttcaagggcaagggcgaggacgaagttgccgtggatactgcaaccggtaagatagtggttcgggtcaatccgaagttttaccgtccagcggaagtggacctactgatcggtagcccagccaaggccaaggccaagctgggttgggaaccgaagacaacgctggagcaactctgccagatgatggtcgaggccgatctgcgccgcaacacggaaggtttctcattttgagaattctgcttactggtgctgatggattcaccgggcgccattttctgacggccgcgaaagcggccggccatgaggttgttgcactgagggccgatttgacggacaaggctgtattgcaacgcgaagttgaggcggctcgtccggaagcagtggttcatctggcagcgatcagttttgttggtcatgcggatgttagtgccttttatgacgtcaatgtgatcggtaccctgaacctgttggatgcgctggctggcttgtccgtgacgccgcgcagcgtactgctggcaagcagtgcgaatgtgtatggcaatgcagcgcattcacctatcaccgaagagcaggcgccggcgccggtcaatcactatgcaatgagcaagctggccatggagcacatggcccgtacctatctggacagactgccgttgttttttgtgcggccgttcaattacacggggccggggcaggctgagtctttcgtgattcccaagctggtggcgcatttcgcgtgcaaggcgcagaccgtggaactgggcaatctggatgtggagcgcgagttcaatgatgtggctttcgtttgcgaggcctatctgcgtttgttggacaaggctgtgccgggtgaggtgtttaatatctgcagcggtgctccggtgacattgcgtgcagtaatcgggatgttgagggaattgacggcgcatgatatcgaggtcaaggtaaatccgcagttcgtgcggaataacgagatcaagacattatgcggtgatccatcaaagctgttccgtactattggagaggggaggctggttcctttagcgcttaccttgaagatcatgctggaacacgctacgcgaaaagaaaaaaaatgatgaaggtaggttttggtgtcaccgtgcttacacgttgcctggcattggggggaatcgatggaattggtagttatacccgggagctgatgaaaagactcgaggctgacccggccgtcgagcttttccctatctcgtacgggtattctccgtcacagtttcctatcggctcacgtgctccgacgacatttggacgatatgcgccgcttgctgcagtatcggctgtatccgggtttccctttctgggaacagctcaattgaaggagcgtgttgatctgattcatgcgcctgatcatcttattcccaactacggaaaagttcctgttattgcatccatcatggacgcgattcccttgtcgcatccggagtgggtatcccccaagttgcgcaagatgaaaaatgcgttatggaagcgctctgcgcactgggcatcgcatatcattactatctctgagtattcgaagcaggaaatttcacagcatttcggtattgaggcacaaaagatcagtgccatcccgcttggcgtggatgagcggtggtttcagccgttggaagaagaggcgatgaaggtggtattgagacggtacaatctgcctcaatactattttcttgtcgtggggacgctgcagccaaggaagaatgtcggccgggtaatcgaggcatatcggtccttgccccaagggatacgtaacgaagtgccgttggtgattgttggtagggcagggtggcgatgcgaggatgtggttgaaatgttgacttcgtcttcttcaggaaattctctgaggtggctcaagcatttgccggatgccgacttgcttgcagtgttgaaaggtgcaacggctttggtctttccttcgttgtatgagggatttggtttgcccgtagtcgaagcttttgcggctggaactcccgttattacttccaataccacttctcttccagaggtggcgggcgatgccgccatgctggtgaatcctctgaatgtcagcgacattgccgctgcaatgcaatcgatgctggaacagccggaactggcagagagtttcaggaacaaggggcaagaacgcgcattggcatattcgtgggacaaaacagcctccatgacgcttgacgtctataaaaagacgcgagaggctgcttaacatcaacgcaccgtcaaacatcgcactccttccctttttatgatcatccgttttctgggcgcacagtggctcgccgttggttttgtcggggtcatctctctggcggtcagcattttgattgcgcggacgcttgggccggattcatttggtgtttattcggttgtcttgtccggcggagccattgccgccattctgcttgatggtggtttcgggcgattgttgcaaagagaacgcgcccatcccacacctgcattgctcagattcctgcccatattgccgcaggctgccttggggcatgtgattatcgcggccagcatattttcgttgatcgctttattggtactgcccaagcatgcgctgacgattgttgcggttatctggtttttcgcagcatctgtgaccaatcagttcggtttgaacattctccgcggagatgggcggatggtaagggatgcctcgtggcagatgggcaatcgaaccttcacagctgcgtgcgtgtgcattgtcattctgatgggagctgagaaaccgtggcaggtattctttgcccagtttgtcggtgcgaccgccttcggtttgctgatcatgcactatctgcgcacgcgcccgctatggaagattcctcctactctttatgcggcaaccttgccattcgtgtggttggatctcgcgacagtcctttattttcgagcggacatgctgttgctggaatggttagatgtgtccaagtttgaagtcgggaaatacggggttgcctgccgcttgattgaggcggtgattctgcttgcttcgccgctctgtattattttgttccgcaagtttcgtctgggtagcgcttctccccgactgatgttgcggagaatgctgccggtgctggcaggggcgctgatggttggagtgttcttcatggtgtttttctggttgtgcagcacgcctttgatcgcggttgcatatggcgaggcctatgcgggagctgatcatattctggcgatactcggctgcgctttgctttttattttgccaaatggcgtgctgaaccaagctgcgctagcgctgggtatcgaacgttggctggcaatgtcggcatcttttgccgcagtgctaaatattgcaggaaatctctggctgattccccaatatgggttgattggagctgcctggatgactgttgtgaccgaagcggtgttaggctgctgcgttgcgttagggctatggcgccaccgtaataggagtgtttaatgcaggatcttgccgttgctcatgtttatcgtacctattttcctgaccctccaggcgggttgcaggaggcaattcgccagattgccctcacgacgggtatgcagggcgtcgataatacggtgtttacgctttctccgcagccgcgtccggcaatcttgcagcgtccggaggcttgtgttgttcgttgccgctcctgggcggctccggcatcatgcgatctgggcggtatcggcgcatttcttgcgttttccaggttggcggaaaaatctgatgtgctacattacctttttccgtggccatttgcggatgttctgcatacggtggttcgcccaggttgtccggccgtcatgacttatatctcggacgtggtgcgtcagcagcttttagggaggttatatgctcctttgatgtggaaggtgttgcgccagatgaggcttgtggtggcgaattctccagcgtatgcacgcaccagtcccgttctctcccatcctgagattcgcgaaaaagtcagggttattccacttggtattgaggagtcttcttatcctaaatcaggggatgaggagattctgcagcgtctaggcattgggaaggatgagccttattttctttttattggcgttcttcgttattacaaaggcgcgcattttctggtcaaggcagcaaagcggataggcgcaaaggtggtgtttgctggcgcggggccggaaggcgcgcgcctgaaagcattggctggcgaagtcggtgcagagaatgtgatttttgccgggatggtgactaacgcggaaaaagtaaccttgcttcaatgctgcagagcgcttgtgttgccatcgcatttgcggtctgaagcgtacggcatggtgctggtagaggctgccatgttcgggaagccgctgatttcttgcgaaattggcacaggcacttcatatgtcaaccatcatgaagaaacagggtttgtcgttgagccggcctctcctgaagcattggcgtcggcgatggcggttttgttatcagaggataggctggctacagagatgggagctgctgctcgtcagcggtatgagctgctcttttccggcccggcattaggaaaggcatatgctgcattgttccgcgaagttgacgcttcgtagcagagtgcgtcatgatgaagtagccagagttgtaacgtttttgggattatcctgttggttttcttgattgttaatacatgatgcaattactggtgacaggcgctacagggtttgtaggtaaaactttgtgcagtgcgctaaggcggcagagcttccccgtaaaagcaattgggcgtgcgggcactatccgggctgacgctttgggtgatcaggttgcttcaattgacggtcaaacggattggtcactgatattggacggcatcaatgccgtcatccatctggcagccagggtgcacgtcatgcgggaacagcttgctgatcccttggcggcatatcgtgaaacgaatgtcgaagggacgctgaatctggcgcgtcaggcggcaaaggccggagttaagcggtttgtattcattagttccatcaaggtcaacggcgaacagactctacctggaaagccttttactgcgtacgatgtaccagctcccgaagatgcgtacggtatttcaaagttcgaggcagagcagggtttgctggccctggcgcgggagacagggatggatgtggtggttattcgccctcctttggtttacgggcctggagtgaagggtaattttgccagtatgatgaagttggtgaaaagtggaataccgttgcctctgggcgccattcataaccaacggtctttggtggcgattgataatttggtgaacctcatcgtcacgtgtattgaccatcccgcggcagccaaccaggtttttttggtaagcgatggcgaggatttgtccacttcagatttgttgcggcgtttggccaaggctgcgggcgtttcctcccgattgatgccagtgtctgcccgctggctagagatgggtttgcgtatgtgtggcaagcgattgatcgcccagcgtctcctgggatcattgcaagtcgatatttccaagacgcgcgagttgttggggtgggttccgccgatctcagtggatgagggcttgaagcgctgtttctctaccaagggctgattcttgatccgattttttgacattattttttcggtgataggcttggtactgggattcccgctattgctatcgatttataccctcggcttgtttgatacaggtgctcccttgtttcgccaggtgagggttgggcgctaccggcagccgtttactttggtgaaatttcggacgatgaaggtggatacggcttctgtggcgagccatctggcttccaccaattccatcacccggctcggacggttcttgcgcaggaccaagctggatgagctgccccagctctggaatgtcctgaagggagaaatgagcctggtggggcctcgaccgaacctgttcaatcaggaggagctgatggccgagcgcgagttgcgtggcgtttaccatgcgcggccagggattaccggccttgcacaggtgaatgatatagacatgtcgacgccaaggctgcttgccgagaccgatgccaggatgctgcgcgagatgaatgtacggctttatttcaagttgctgattcagacggtgctgggtcgaggacagggcgaccgggtcgtgcgctgagctcggcaggaaccaatgcctggctacaaagtgttgatccatgattggtcgtcactgtcccgtggtttttagtagaatgttattcattttcactttaggctgggcgcgtgctgcattatttcccctcattcaagtggtcgaactacatcagtttgaagaatccacgctctttgagcgcttggatatatgacattgttgctgctgcgctggcatggtgggcagccttcctgttacggttcaattttgatattccggccaattttgtccagagtatgctcgacagcgcagcatgggtgattccgctgcaggcatttgtgtttctgctggctgggttgtacaaaggcgtctggcgttttgccagcctgccggatttgcagcgcttggtgcgcgcgattgcgatcagcgcagtgcttgtggttgcgatcttgttcatgttcaagccacacggcattgttcctcgctcggtgctgatcttggatcctatgctgttgctgctgttgatgggcggcagccgctttgcttaccgagcatggaaagaacatcgcctgtatggttctgcccagttttccggaaagccggtgctggtgctcggcgcgggtgaggcagcgattgccttgttgaaggatctttccaaaagccgtgaatggcatgtcgttgggttgctggacgataagaaaaccatgcatggccgagagctactgggcgtcaatgtgctggggtcgattgcgcaattgccacagatcgctgcggatttgtcggtcaatcatgtgattgtggccatgccatccgcgcgtcatcaacgacgcagggaaatcgtcgagctggcaagcagaaatgggctgactgcgctcacggtgccgtcgtttgatgacctgatgagtggccacctgagcatggcacagattcggccggtcgaggtggaggacttgctggggcgggagccggtcagtctcgatggagaggggctccagcatttgatcgaggggcaggtgttgctgattactggtgcaggtggttccatcggttctgagttatgccgccaggtgctgaaataccgtccagcttgcctggtctgcctggatcagtcggagtacgcgttgtatcggttggagcaggagtttgacaatctggagtttgatacccgcattgaatacgtggttggcgatgtcaggaacgcacgccgggtggggcaggtgcttggccgttatatgcccaaactggtgttccatgctgctgcgtataagcatgtgcctttgatggagaaccgcaatgtggcggaatcattgtcaaataatgtcagcggtacttacacgctcgcccaggcatgcaaaactgcaggggttgccaagttcgtgctgatttccaccgataaggcggttaatcccaccaatgtgatgggggccagcaagcgcctggcggaaatgatatgccaaggcctgcaggaggagtcgggtacgcgttttatcgtggtgcgctttggcaatgtgctgggcagtagtggcagtgtaatccccaagttccgtgagcagattgcggcgggcgggccaattaccgttacccatcccgagatcactcgctatttcatgtccatcccggaggcgtgccagctggtcatgcaggctggattgatgggtggtggcggggagatatttgtgctggatatgggagaccctgtgcggattgtggacttggcccgtgatatgatccggttatccgggcttaatgaagatgacattcagattgtatactctggcttgcggcccggcgaaaagctgtacgaggaacttttggctgacgacgagctcactgtaccaacaccccacgacaagctacgtattgccgtggcgcgaagcgtggatggtgcttgggttcaggcattgctgaaatggatcgacagggcatcgctcatagatgaatctgtcatcaagcaagagctgggcatgtgggtggaggagtatgcaggggatattcatgccaatccatccatgatgttcccccccgagtcttcaaccatacattagaagaaagatagatagaaatggcaaaaaaaattaccaaggcagtatttccagtggcaggtttagggacacgtttcctgccagcaaccaaggcgagtcccaaggaaatgttgccaattgtggataagcctctgattcagtatgcagcagaggaggctgtggccgccggtgctaccgagctgatttttattatcgggcgcaacaagcgcaccatcccggatcattttgataagtccttcgagctggaagcgacgcttgaggcaagcaagaaaaccaaggtgctggaagaaatccgcaatatcctgccaaaaaatgtttcctgcatctatattcgccaggccgaggcgcttggtttggggcatgcggtattgcttgccaagtccgtggtcggcagcgagcctttctctgtgatcctggccgatgaccttattgatgccgacaaacctgccatgcagcagatgacagagctgttcgaccaagagggtgtcagcattctgggtgtcgaggatgtggagcccagtgagacggcaagctatggcattgtggatgcgacagaggtgagtggcccgaatgtgttgcaattgaatggcattgtggaaaaaccgcagccggaagaagcgccctccaatctggctgttgtcggtcggtatattctcacgcctgaaatttttgaatgcctggagaacgtcaagccgggcaagggcggggaaatccagttgactgatggcattgccgccttgatggaaaaacagaaaatcctggcttaccgtttcgatgggaagcgctacgattgcggcagcaagctgggttatgtcaaggcgaacgtcgagtattccttgaagcatgaggagtttggcaaagagtttgcccagtacttacgtgatctaaccaagtagcagtcgtggtggtacttgagggtaaccccgatctcattctgcagcgatccacgctggtctcttctgaagaggaagtgaagcaggcggtgacgagggtggcgcaggaaatcactgccacgctaaggcaggaccaacctctcgtcctgtgtgtcatgggaggcggggtggtattcaccgggcaattattgccacagctggttttccctttggagttcggttatgtgcaggccacccgctatcacaaccggacacatggcgatgcccagctggtgtggaaaatgaagcccggggaggaggtgcgcggccgtaccgttttattgctcgatgatattctcgatgagggggtcacgctggcagaaatcaaggcgcagtgtctggcactgggtgccagcaaggttgtcgttgcggtcttggttgaaaaaatgctggggcgggtcaagccgatcagggctgatttcgtcggactggaggtgccggaccagtatgtattcggatgcggaatggatgcctatgggtggtggcgtaatttgccggccatttatgccatgcaaggggaagcttga

SEQ ID NO: 176 - DNA, 13733 bp, Methylobacillus flagellatus
tcaagcttccccttgcatggcataaatggccggcaaattacgccaccacccataggcatccattccgcatccgaatacatactggtccggcacctccagtccgacgaaatcagccctgatcggcttgacccgccccagcattttttcaaccaagaccgcaacgacaaccttgctggcacccagtgccagacactgcgccttgatttctgccagcgtgaccccctcatcgagaatatcatcgagcaataaaacggtacggccgcgcacctcctccccgggcttcattttccacaccagctgggcatcgccatgtgtccggttgtgatagcgggtggcctgcacataaccgaactccaaagggaaaaccagctgtggcaataattgcccggtgaataccaccccgcctcccatgacacacaggacgagaggttggtcctgccttagcgtggcagtgatttcctgcgccaccctcgtcaccgcctgcttcacttcctcttcagaagagaccagcgtggatcgctgcagaatgagatcggggttaccctcaagtaccaccacgactgctacttggttagatcacgtaagtactgggcaaactctttgccaaactcctcatgcttcaaggaatactcgacgttcgccttgacataacccagcttgctgccgcaatcgtagcgcttcccatcgaaacggtaagccaggattttctgtttttccatcaaggcggcaatgccatcagtcaactggatttccccgcccttgcccggcttgacgttctccaggcattcaaaaatttcaggcgtgagaatataccgaccgacaacagccagattggagggcgcttcttccggctgcggtttttccacaatgccattcaattgcaacacattcgggccactcacctctgtcgcatccacaatgccatagcttgccgtctcactgggctccacatcctcgacacccagaatgctgacaccctcttggtcgaacagctctgtcatctgctgcatggcaggtttgtcggcatcaataaggtcatcggccaggatcacagagaaaggctcgctgccgaccacggacttggcaagcaataccgcatgccccaaaccaagcgcctcggcctggcgaatatagatgcaggaaacattttttggcaggatattgcggatttcttccagcaccttggttttcttgcttgcctcaagcgtcgcttccagctcgaaggacttatcaaaatgatccgggatggtgcgcttgttgcgcccgataataaaaatcagctcggtagcaccggcggccacagcctcctctgctgcatactgaatcagaggcttatccacaattggcaacatttccttgggactcgccttggttgctggcaggaaacgtgtccctaaacctgccactggaaatactgccttggtaattttttttgccatttctatctatctttcttctaatgtatggttgaagactcgggggggaacatcatggatggattggcatgaatatcccctgcatactcctccacccacatgcccagctcttgcttgatgacagattcatctatgagcgatgccctgtcgatccatttcagcaatgcctgaacccaagcaccatccacgcttcgcgccacggcaatacgtagcttgtcgtggggtgttggtacagtgagctcgtcgtcagccaaaagttcctcgtacagcttttcgccgggccgcaagccagagtatacaatctgaatgtcatcttcattaagcccggataaccggatcatatcacgggccaagtccacaatccgcacagggtctcccatatccagcacaaatatctccccgccaccacccatcaatccagcctgcatgaccagctggcacgcctccgggatggacatgaaatagcgagtgatctcgggatgggtaacggtaattggcccgcccgccgcaatctgctcacggaacttggggattacactgccactactgcccagcacattgccaaagcgcaccacgataaaacgcgtacccgactcctcctgcaggccttggcatatcatttccgccaggcgcttgctggcccccatcacattggtgggattaaccgccttatcggtggaaatcagcacgaacttggcaacccctgcagttttgcatgcctgggcgagcgtgtaagtaccgctgacattatttgacaatgattccgccacattgcggttctccatcaaaggcacatgcttatacgcagcagcatggaacaccagtttgggcatataacggccaagcacctgccccacccggcgtgcgttcctgacatcgccaaccacgtattcaatgcgggtatcaaactccagattgtcaaactcctgctccaaccgatacaacgcgtactccgactgatccaggcagaccaggcaagctggacggtatttcagcacctggcggcataactcagaaccgatggaaccacctgcaccagtaatcagcaacacctgcccctcgatcaaatgctggagcccctctccatcgagactgaccggctcccgccccagcaagtcctccacctcgaccggccgaatctgtgccatgctcaggtggccactcatcaggtcatcaaacgacggcaccgtgagcgcagtcagcccatttctgcttgccagctcgacgatttccctgcgtcgttgatgacgcgcggatggcatggccacaatcacatgattgaccgacaaatccgcagcgatctgtggcaattgcgcaatcgaccccagcacattgacgcccagtagctctcggccatgcatggttttcttatcgtccagcaacccaacgacatgccattcacggcttttggaaagatccttcaacaaggcaatcgctgcctcacccgcgccgagcaccagcaccggctttccggaaaactgggcagaaccatacaggcgatgttctttccatgctcggtaagcaaagcggctgccgcccatcaacagcagcaacagcataggatccaagatcagcaccgagcgaggaacaatgccgtgtggcttgaacatgaacaagatcgcaaccacaagcactgcgctgatcgcaatcgcgcgcaccaagcgctgcaaatccggcaggctggcaaaacgccagacgcctttgtacaacccagccagcagaaacacaaatgcctgcagcggaatcacccatgctgcgctgtcgagcatactctggacaaaattggccggaatatcaaaattgaaccgtaacaggaaggctgcccaccatgccagcgcagcagcaacaatgtcatatatccaagcgctcaaagagcgtggattcttcaaactgatgtagttcgaccacttgaatgaggggaaataatgcagcacgcgcccagcctaaagtgaaaatgaataacattctactaaaaaccacgggacagtgacgaccaatcatggatcaacactttgtagccaggcattggttcctgccgagctcagcgcacgacccggtcgccctgtcctcgacccagcaccgtctgaatcagcaacttgaaataaagccgtacattcatctcgcgcagcatcctggcatcggtctcggcaagcagccttggcgtcgacatgtctatatcattcacctgtgcaaggccggtaatccctggccgcgcatggtaaacgccacgcaactcgcgctcggccatcagctcctcctgattgaacaggttcggtcgaggccccaccaggctcatttctcccttcaggacattccagagctggggcagctcatccagcttggtcctgcgcaagaaccgtccgagccgggtgatggaattggtggaagccagatggctcgccacagaagccgtatccaccttcatcgtccgaaatttcaccaaagtaaacggctgccggtagcgcccaaccctcacctggcgaaacaagggagcacctgtatcaaacaagccgagggtataaatcgatagcaatagcgggaatcccagtaccaagcctatcaccgaaaaaataatgtcaaaaaatcggatcaagaatcagcccttggtagagaaacagcgcttcaagccctcatccactgagatcggcggaacccaccccaacaactcgcgcgtcttggaaatatcgacttgcaatgatcccaggagacgctgggcgatcaatcgcttgccacacatacgcaaacccatctctagccagcgggcagacactggcatcaatcgggaggaaacgcccgcagccttggccaaacgccgcaacaaatctgaagtggacaaatcctcgccatcgcttaccaaaaaaacctggttggctgccgcgggatggtcaatacacgtgacgatgaggttcaccaaattatcaatcgccaccaaagaccgttggttatgaatggcgcccagaggcaacggtattccacttttcaccaacttcatcatactggcaaaattacccttcactccaggcccgtaaaccaaaggagggcgaataaccaccacatccatccctgtctcccgcgccagggccagcaaaccctgctctgcctcgaactttgaaataccgtacgcatcttcgggagctggtacatcgtacgcagtaaaaggctttccaggtagagtctgttcgccgttgaccttgatggaactaatgaatacaaaccgcttaactccggcctttgccgcctgacgcgccagattcagcgtcccttcgacattcgtttcacgatatgccgccaagggatcagcaagctgttcccgcatgacgtgcaccctggctgccagatggatgacggcattgatgccgtccaatatcagtgaccaatccgtttgaccgtcaattgaagcaacctgatcacccaaagcgtcagcccggatagtgcccgcacgcccaattgcttttacggggaagctctgccgccttagcgcactgcacaaagttttacctacaaaccctgtagcgcctgtcaccagtaattgcatcatgtattaacaatcaagaaaaccaacaggataatcccaaaaacgttacaactctggctacttcatcatgacgcactctgctacgaagcgtcaacttcgcggaacaatgcagcatatgcctttcctaatgccgggccggaaaagagcagctcataccgctgacgagcagcagctcccatctctgtagccagcctatcctctgataacaaaaccgccatcgccgacgccaatgcttcaggagaggccggctcaacgacaaaccctgtttcttcatgatggttgacatatgaagtgcctgtgccaatttcgcaagaaatcagcggcttcccgaacatggcagcctctaccagcaccatgccgtacgcttcagaccgcaaatgcgatggcaacacaagcgctctgcagcattgaagcaaggttactttttccgcgttagtcaccatcccggcaaaaatcacattctctgcaccgacttcgccagccaatgctttcaggcgcgcgccttccggccccgcgccagcaaacaccacctttgcgcctatccgctttgctgccttgaccagaaaatgcgcgcctttgtaataacgaagaacgccaataaaaagaaaataaggctcatccttcccaatgcctagacgctgcagaatctcctcatcccctgatttaggataagaagactcctcaataccaagtggaataaccctgactttttcgcgaatctcaggatgggagagaacgggactggtgcgtgcatacgctggagaattcgccaccacaagcctcatctggcgcaacaccttccacatcaaaggagcatataacctccctaaaagctgctgacgcaccacgtccgagatataagtcatgacggccggacaacctgggcgaaccaccgtatgcagaacatccgcaaatggccacggaaaaaggtaatgtagcacatcagatttttccgccaacctggaaaacgcaagaaatgcgccgataccgcccagatcgcatgatgccggagccgcccaggagcggcaacgaacaacacaagcctccggacgctgcaagattgccggacgcggctgcggagaaagcgtaaacaccgtattatcgacgccctgcatacccgtcgtgagggcaatctggcgaattgcctcctgcaacccgcctggagggtcaggaaaataggtacgataaacatgagcaacggcaagatcctgcattaaacactcctattacggtggcgccatagccctaacgcaacgcagcagcctaacaccgcttcggtcacaacagtcatccaggcagctccaatcaacccatattggggaatcagccagagatttcctgcaatatttagcactgcggcaaaagatgccgacattgccagccaacgttcgatacccagcgctagcgcagcttggttcagcacgccatttggcaaaataaaaagcaaagcgcagccgagtatcgccagaatatgatcagctcccgcataggcctcgccatatgcaaccgcgatcaaaggcgtgctgcacaaccagaaaaacaccatgaagaacactccaaccatcagcgcccctgccagcaccggcagcattctccgcaacatcagtcggggagaagcgctacccagacgaaacttgcggaacaaaataatacagagcggcgaagcaagcagaatcaccgcctcaatcaagcggcaggcaaccccgtatttcccgacttcaaacttggacacatctaaccattccagcaacagcatgtccgctcgaaaataaaggactgtcgcgagatccaaccacacgaatggcaaggttgccgcataaagagtaggaggaatcttccatagcgggcgcgtgcgcagatagtgcatgatcagcaaaccgaaggcggtcgcaccgacaaactgggcaaagaatacctgccacggtttctcagctcccatcagaatgacaatgcacacgcacgcagctgtgaaggttcgattgcccatctgccacgaggcatcccttaccatccgcccatctccgcggagaatgttcaaaccgaactgattggtcacagatgctgcgaaaaaccagataaccgcaacaatcgtcagcgcatgcttgggcagtaccaataaagcgatcaacgaaaatatgctggccgcgataatcacatgccccaaggcagcctgcggcaatatgggcaggaatctgagcaatgcaggtgtgggatgggcgcgttctctttgcaacaatcgcccgaaaccaccatcaagcagaatggcggcaatggctccgccggacaagacaaccgaataaacaccaaatgaatccggcccaagcgtccgcgcaatcaaaatgctgaccgccagagagatgaccccgacaaaaccaacggcgagccactgtgcgcccagaaaacggatgatcataaaaagggaaggagtgcgatgtttgacggtgcgttgatgttaagcagcctctcgcgtctttttatagacgtcaagcgtcatggaggctgttttgtcccacgaatatgccaatgcgcgttcttgccccttgttcctgaaactctctgccagttccggctgttccagcatcgattgcattgcagcggcaatgtcgctgacattcagaggattcaccagcatggcggcatcgcccgccacctctggaagagaagtggtattggaagtaataacgggagttccagccgcaaaagcttcgactacgggcaaaccaaatccctcatacaacgaaggaaagaccaaagccgttgcacctttcaacactgcaagcaagtcggcatccggcaaatgcttgagccacctcagagaatttcctgaagaagacgaagtcaacatttcaaccacatcctcgcatcgccaccctgccctaccaacaatcaccaacggcacttcgttacgtatcccttggggcaaggaccgatatgcctcgattacccggccgacattcttccttggctgcagcgtccccacgacaagaaaatagtattgaggcagattgtaccgtctcaataccaccttcatcgcctcttcttccaacggctgaaaccaccgctcatccacgccaagcgggatggcactgatcttttgtgcctcaataccgaaatgctgtgaaatttcctgcttcgaatactcagagatagtaatgatatgcgatgcccagtgcgcagagcgcttccataacgcatttttcatcttgcgcaacttgggggatacccactccggatgcgacaagggaatcgcgtccatgatggatgcaataacaggaacttttccgtagttgggaataagatgatcaggcgcatgaatcagatcaacacgctccttcaattgagctgttcccagaaagggaaacccggatacagccgatactgcagcaagcggcgcatatcgtccaaatgtcgtcggagcacgtgagccgataggaaactgtgacggagaatacccgtacgagatagggaaaagctcgacggccgggtcagcctcgagtcttttcatcagctcccgggtataactaccaattccatcgattccccccaatgccaggcaacgtgtaagcacggtgacaccaaaacctaccttcatcattttttttcttttcgcgtagcgtgttccagcatgatcttcaaggtaagcgctaaaggaaccagcctcccctctccaatagtacggaacagctttgatggatcaccgcataatgtcttgatctcgttattccgcacgaactgcggatttaccttgacctcgatatcatgcgccgtcaattccctcaacatcccgattactgcacgcaatgtcaccggagcaccgctgcagatattaaacacctcacccggcacagccttgtccaacaaacgcagataggcctcgcaaacgaaagccacatcattgaactcgcgctccacatccagattgcccagttccacggtctgcgccttgcacgcgaaatgcgccaccagcttgggaatcacgaaagactcagcctgccccggccccgtgtaattgaacggccgcacaaaaaacaacggcagtctgtccagataggtacgggccatgtgctccatggccagcttgctcattgcatagtgattgaccggcgccggcgcctgctcttcggtgataggtgaatgcgctgcattgccatacacattcgcactgcttgccagcagtacgctgcgcggcgtcacggacaagccagccagcgcatccaacaggttcagggtaccgatcacattgacgtcataaaaggcactaacatccgcatgaccaacaaaactgatcgctgccagatgaaccactgcttccggacgagccgcctcaacttcgcgttgcaatacagccttgtccgtcaaatcggccctcagtgcaacaacctcatggccggccgctttcgcggccgtcagaaaatggcgcccggtgaatccatcagcaccagtaagcagaattctcaaaatgagaaaccttccgtgttgcggcgcagatcggcctcgaccatcatctggcagagttgctccagcgttgtcttcggttcccaacccagcttggccttggccttggctgggctaccgatcagtaggtccacttccgctggacggtaaaacttcggattgacccgaaccactatcttaccggttgcagtatccacggcaacttcgtcctcgcccttgcccttgaactcaacagcaatgccagcccccttgaacgccatgcttacaaaatcgcgcacagtctcggtacgattggtcgccagtacaaaggtatccggctcatccgcctgcaggatgcgccacatgccttccacataatccttggcatagccccaatcacgctttgcatccaagttacccaactccaggcaatcaagtttccccagcttgatcttggccaccgaatccgtgatcttgcgcgtcacgaactcgcgaccacgcaacggactctcatgattgaataaaataccgctagatccgaagattccatagctttcacgatagttaacagtcatccagtgcgcatacagcttggcgacaccataaggactgcgtggatagaaaggcgtatcttccgtttgtggaatcgcctgcaccttgccgaacatttcggatgtggatgcttggtaatagcgaatattgggatttactaaacgaatggcctccaaaagattgagcgcaccgacacctgtgatctccgcggtagtaataggttgctcaaaagacacgcccacaaaactttgcgcagctaagttgtacacttctgttgcacctgtgctctgcaatagacggatgcttgctgacaaatcggtcaggtcgtattcaaccaaaagaagatttgggtcattttcaattcccagctcttcaatacgccagaagttgaccgagcttgtacggcggaaggtaccgtaaaccttatagcctttactaaggagaagttctgcgagatatgcaccatcttggcctgtgatgccggtaatgatggcagtttttatggtcatcgtattatgccttatgtatttaaagtcttactgtatatgtatatatggtatgtaaataatggattcgttagaacagcgtctaaattatcttattattttccttcatctttttttggaaactagacgatttcgatctcaggaaatgggaagataaacctgccgccatcagctagaaagtccttttcacggcgcaggataccatctttgaaatgccatggaagcaccaagaagtagtcgggcttggcagcgcgcgcctctttttccgaaataatgggaatatgcgttcccggagtgactcgtccgaatttttcttcgtttacttctgcaatggcagggatttcctcagaagtaaagccacaaaattgtagtactacattacctttggcagaagctccatacccatatatttttttgccgtcagctactaacgaatgaattaagcgcctgagatcatcgcgatgacgatatacacgctcctcaaattcacgataaggccttggggtagataatcccatccggtcttcttgctcaagcatccaattgatcactgcaaggttaggcttaatactcgtattagaacgcttggcagcagtcacggcaaagctgcctccgtctctcctggctggatatgaaaacttactccttgcagaatccacttcaattggtggtgcggcttacgcctcagatctatccactccaacaaccgagaccagcgactggggtattgcttgtaggccttacccaggttggtgacaacaatagtacccattaaagttcatccaccatatcgcccgcatgtttgcggaataaagacagccccagcaggcacaacacgatagacagcgcaaacactggccatagactgtaccagtccggccattttgcttgtaccaatattccttggaaagcctccatcaagcgcgccatggggttaagccgcatataatcttgtacccgttctggaagaatgctgaccggatagacaatcggcgtaagccaaaaccagaaactaagcacaatgccaaagaactgacctacatcgcggaaaaacacattgagaacgcccaatataatacccaagcctagagcaaagacgatcatcagtatcaataccgggatcagcaccaaataaggccaacccgaaaacataccgatcagcagcaagaacgctgtgaacaacccaaaaacaatggcaaagttaactagcgcggtggcggtgacgatgactggcagacatagacgggggaaactcagtttcttgagcaagttggcattatcgatgaacgtggtctgtgagcgcccgacaatctcagcaaacaagccccaggtgagtatgccagcgcataaatgaatgctaaacgcaaaagtactgtccacgccaggcaaacgagccttcattacctgcgagaaaatcactgtgtacactacgatcattgcgagggggttcaagaccgtccagactgcgcctagcagcgaattacggtacttggattgaaactcgcgcttgacgctgcccaacacaaagccgcgataaagccataaggcttttaacatgctgatcatcaagtgcgtccgtagatatcttgaaaacgaacaatatcgtcttcgcccaaatattccccggattgaacttcaataatcaccaggtcaagcaaacctggattttcaagacggtgtttgtgtcctgctggaatgtaagtagactcattggcattaatgagcagctcgcgctcgccgttgacaactttagctataccgcttactacaacccaatgctcactacgatgatggtgcatttgcaagctcaggctggcaccaggctttaccttgatgcatttgatcttaaaattagcgccttcttccaatacggtgtatgtgccccatggacggtgtaccttgcgatggtaatttgccgcactatgggactcaagcttgagttgcttcacaacggttttgacatcctgagctctggagtgatgagccacaagcagggcatcgggtgtatcgaccaccagcaggttatcaatacctataccagccacaagacgggaatcactttggatatagcaattattagcatccaccaataaagcttcgccattcaccctattcccacgctcatctgactggaccaactcagccatggcgctccatgaaccaatgtcgctccagtcaaaatcagctgcgactaccgccacttttgaagcacgctccatgacggcataatctatggaaatatctggacttgatgcaaagtgctcctcgcccaatacaacaggctcagttttggagtcactagatgccagggtcttttttgctatctcaagcacttctggaacatactccgcaagtgcagcaataatggtttttgcagtaaaacagaatatacctgcattccatgtaaatcgacctaaagcaatatatttctcagcagtttccaaatctggcttttcgacaaatcgaacgactctacgcgcgcctgagtccccaattgactctccgccttcaatgtagccataacctgtttcaggcgtgcttggctctacaccaaacgtgactatccagccattcaccgccatatctgtcgcaacagtcactgcttttgaaaaaactttttgattaccaataagatgatctgccggcatcaccaacagcactacatcttccccatgtttcgcagcggcatgtagtgcagcaactgcaatggcaggagcagtattgcgccctatcgtctctagtaagtagctatgggaaacattagtgtctgttgcctcatagacatcacgtgtcaggaagtaatattccttattcgttactgtgagcacttcgctcacaccatccaggcaagcagtacgttgcaaagtcttctgcagaagggttctgccatcaggtaattcgataaatggcttagttagagtttcacgagaaaccggccataatctggaaccggccccgccagacataatgacaggaagcagcattaaaaaacttttttataaaattggctcattatacctaaagagttttaaatactgaattaaattaaatcttgagcattcaatatgaaatctaattatataaaaaatattgctactaaaaacaatatttaacaataaaaaaacatcataaaaatcataatactaaataacacacatcccaaaaattttaaaagattacgcttcaaccaattcagaatatctcatcccaagttaaactcttggattacaagagtatgtttaaactacgttcatcaaggagtctcctcac

SEQ ID NO: 177 - DNA, 26292 bp, Methylobacillus glycogenes
attgatgctggttggtctgggactgctgggctttgctgcacgtcgtcgccaagcttaattaagctgagcacgtaaatgcacgcgcttatcaggcgtgcatttagtcatgctaagagtaaatgaataagtcggcttcatgccgacttattcattttgggtattgtgttggtgcctattcctgaagttgtagcacatactgggaatggcgagcgaaggtgtgacaagacttgtcataaatctatagcagttgcacagtagcatccgcaaggccattcatgcagtgagtgagtctgatttagtccatagggactattgaaatgagaatgcctgtcatttggcgatttgattttgtatcatgagcgtatttcaaactaaggcacatgcatgaacagggcatcactggggccgataagtagccgtgttattcccttcgcggtctatatgctattcatggcaggggtagacctgatcggcgcagttgtgcctgagggttttgatctgcgatggttatatggagtcaaggttggcttggttgcctacttgctttggacattgcgcaaacactatatcgagcttggtggcttgtcgttgcttagtttgaagtcgtggttgagcgcaatcagcattggtgtgctagtatttgtcgcttggattaacctggatgccccgtggatgttactgggcgggccatcgcaaggcttcaatccggggcagggtgtcgaagcgtgtctcctaatggtgacaagaattgtcggtgctgccctagtagtgcctctgatggaagagttgttctggcgttctttcctgatgcgctggatacaaaatcaggacttcctcaaggtggagccggccacggttggtgctgtggcattactggtttcttcactactttttgccatagagcataacctatggtttgctggtctggttgcggggctggcatacggattgctttacatccggagcagaacaatatggatgccgatcatcgcgcatgcggtgaccaacggtgtattgggagtttggattatctataccggtaactggcattactggtagccattggggaagtatttctttgcgactaacagactctactcattataaaaagctggttatcacggcagtcataggttggaatgcagtgggttattccgaccctgtgctggctcgtgaaggtgatgtcatacggccctatgtcagtgcaacatatgtttatgatgacaacctgaggcgccgctctgacaaggagtccgatacgagtgtagtgggccgggttggcattattctggataaggatattagtcagcagaatttctacgccaatatcggtgtgaatgaaaccaaatacaacaaaaattcagagttagacaatacaggtaaagatattgtcgctcgatggaactgggcagtgggctcgcaattccggggcaaggttgagtactataaaaacgaggctatgctgccttttgcggattttcgtggtgtggaattgaatatgcgtattcaggagcgtaaaacttttgaagcaaactggcgtttccattccagttggcgcgcgcgctttggtgtgcagcgccaggatgttgagtatgactctcaaacattgaatgcggcttcttttcaggaaaattcccagcacgtaggtttggactatttagctgagtcaggcagtaaggttggcttggtcttcactaatgggcgtggcacgcggccctttgataggcctgcttttttcccggggattggtaccgtgtttgtcaataatgactacaggcagcaatcactcaaggcggacatactttggctttattctgccaaaacacgatttgaatttttgggggggtatgttgatcgtaaacatgacagcttctcacagcgcgatttttccggatttaatgcccacgggaacatggtgtggtccattaccgacaaaacctctttcaagacagccgcatggcgcgatgcaaatgctatatcaatcgtaactgccagctatgtgattgatagtggcgcaagtgcaagcatctcctatagcgcaacgagtaagatcctgctgtcaacttcagccaggtatcaacaactaaaatttgaaggcgatatcaccgggcaagatcaaggtcgtaccgacaagaataaggttttttcttttggggtaacgtacagccctcttgaatcgttaagtttcactactggtctaaatagaagtttgcgtgactcaacctcaccaattttaaactacaactcgacaagcatttcgcttactggtcgttatgaattctgatggtgtaagataaatgaccgtaaatgacatccctttagtagcgtttttcaagcagctgctcgacccgctgatcattcttggtacgctgtatgtgttcaccctgttgtttggtgagccttttaatggctactacctgattctggcgttgctagcctactttgtttcctctaatgtctacgagcgtctggatctttaccgtacctggcgtagtggcaagatacttggttatatccgcgatattctctttggctggggtattgtcatcgctgtgctgatgttcatcggctatgccgctgatctatccagtcagtatctggatgagatgatatatgcctggtttgccagtgtgccgatgatatttattgtcacgcatctggcgatacgcaaaattgcctcggatttgcacaagaatggtgaagtcaggtccgtagtgattatcggtgccaatgatattggcgtgcgcttgatcaatcgcatcacggacgacccgtacctgtttatggaggtcaaggggatctttgacgacagagaggtcgccaggcaccccaagggcatgcgtaatctgcctttgcttggttccatgtcggaaattgcgccatatgtccgcgccaataatacccagattattttcatcagcctgcccatgtcggcgcagccacgcatcaggcagttatttgaagaattgcaagacaccacagcatctatttactttgtgccggatatctatatttttgatctggtacaagcgcgctttgatgatgtggctggtgtgcctgtggtcgctattcttgagacgccattcaccggtttcaacagtttaatcaaacggactagtgacattattttggcgtcgcttattctattaatgctgtctcccatcatgctgacactggctctggccgtgaagttgacctccccaggcccggtgattttcaagcagcgacgttatgctgaatggtgaggaaatcattgtctataaattccgctccatgaaagtaatggaagatggtgacaaggtagtacaggcgcagaagcgagatcagcgattgacaccgattggtggtttcttgcgcaagaactcactggatgagctgccgcagttcatcaatgtgttgcaaggtcagatgagtatcgtggggcctagaccgcatgccgtttctcataatgagcaatatcgcaagctgattcgtggctatatgctgcggcacaaggtcaagcctggaataacaggctgggcgcaggtgaatggtttacgtggtgaaactgataccttggacaagatggagtcccgtatcgagtatgacttggattatttgcgccattggtccctggcttttgacttctggattatcgtcaggacggtgctggttgtgttcaaaaaagataacgcctactaggttgtttaaatagatttgaggagattggaaagtgaataacggatttgtaactaacttcaagcaatccagaaccctgtgtgtcggtgctgtgattgtgctcgctttcgcattgtcgggctgtggcgacaagcatgaatccaaagccagccagtctctggttaaggtcaatggcaaggaaatcaccgtacatcagctgaatcaggagctgggtcgtgccaacattcaggagaatcagcgcgagcaggcaacgcagcagattctgactgcattgatagatcgccagttacttgaagaagctgcgctcaaggccaaggtggatagggatccaaatgtgatgaccacgattgaacgtgcgaaatcacaaatcattgctcaggcatatctgcaatccaagttaggcagtgtcgccaagccaagcaaaacagaaattgagaatttttataacgagaatcctcaattcttcagcaagcgcagaatggtggaaatggatcaattgttgattgatactaaattcgccaatgatgaattgaaaacagcacttggcaaactcaagaccttgcaggaagtagccgcatggatggatgcccataatattcagtacgatcaaggtcaggtttcacgcagtgttgctgaattgccgccacagatttccgagcgcctcaaggccgaggataagggtaagttgttcgtgatcggcatgggccctcgcaccatgttgatcatgatgaacgagatcaaggacagcccagtttcacttgcagaagcaacaccgcaaattgaaaacaatttgctgaataaggcgcgcaaggaagttgctgaaaatgaagtcaagcgcttgaaagccgatgccaagattgagtacatcgataaaaagatggaaacagcgactgaaaccaaggcagccaaaaagaagccaagctctactgaggatgatatcgccagtggtgttagtggcttgaaataagtactccccatccttaatatcaggacgatagtaaaatgaaaaaattaatgacatggtttttcttgctgatgctgagtctgacgccttttgtaacgcatgctgcagaaggtgacattcttctcggcgctggcgatgtgctgaaaatatcggtgttcgagcagcctgatctgtcacttgaggtcagagtgagtgaatcaggttccattacttatcccctgataggtgaagtgcgtgtgggtggtggtacggttgccgccgccgagcaaagaattgccaccatgctggaaaagggtggtttccttaagagtgctcacgtcaacatcatcgttgcgcaattgcagagccttcaagtctctattctgggtcaagtcaatcgcccgggcagataccctatagatagcgctaaaacgctggcggatgtgcttgccttggctggtggtgtatcacctgaaggtggcgatctgatcacgctggtgcataacgtcgatggtaaagcggtcagggatcagattgaccttgctgacatgatgcgtactggcgatctcagcaagaacatccgcgtagctggtggtgacatcatttatgttgaacgtttcgataaattctatatctatggtcaggttcaacgtgccagccattaccgtctcgaacatgaaatgacagtattgcaagcgctttctgtaggtggtggcttaagccctcgcggcacagaaaaaggcgtcaagatcaagcgtcgtgatgctagcggccatattgaagtaatcactgccaaacatgatgacctcatcaagcccaacgatgtgatctatgtgcaggaaagtttcttttaatagattgcagattttaataaatacttgataggcaaggttaatctaatgagcttttctcaacttttactgatattcaaagcgcgatataagatattgttaagcaccattgttgtggccctggtcgtagcaattgcgctcaatattttcttgccaaacagctataaggcaaccaccagtatcctagtcaactataaaggtgtagatcctgtgactggtatggctgtccctgcccagctgcttccaggttatatgggtacccaggtggatatcataactagcaagaaaattgctaagagggttgtgaccacattaaagctcaatgaaagtagtgaggttgtggagagtttcaatgactccacaggtggtgaaggtgatatcgttgattggttggcggatttgctgatctcacgtatcgaagttcaacctgcgcgcaacagtagtgtgttgcagctggagtttgatggagccaaccccaaatttgctgctgttgttgctaactcctttgccgaggaatatatcaaggccactatcgaactcaaggttgagccttcgaaaaaggcggctgaattttataccgggcaattgaaggatttgcgtgccgatattacccgggcgcagcaaaagctttccgattaccaacaagataaaagcatcgtcagcgttgatgagcgtctagacattgaacgtgccaagctgaatgaactttcctcgcagttagtgatgtcacaagggcaaactcttgaggcacagtctcgtcagactggtgcacaaggtagcaatgcttatggatctccggatgtcgcgagtaatccaatggttctgcacctgaaaacagagattgctaggtctgaatcacgcttcgcggatatctcacaaaaatatgagagaaatcacccactctatcagggggccaaagctgagcttgacaatctgaagtctgaattaagtaagcaaatccaggcggctaccgtcaatatatcgagcaattatagaatccttaagcaacgcgagagtgaaatccgcaatgccttggctgagcaaaaaaccaaggtcatgctgttgaacaaggatagggatgcactgacggtattgacgcgtgaagtcgagggtgcgcaacgcgcttacgaactcgcgactcagcgatatactcaaataaatcttgagggacagtctaatcaagctgatgtatccatccttaatccagcgacaccaccacttaagccatcaagcccgaaaaaaatattgaacgtggcagttgcgttggtgctgggtacaatttttggcttgttgtttagtttgttggctgagctcactaatgagcgaattcgctcagaaagagtgctggtagagattgttggcgcaccgctgctgggtgtgatcgacaaaaataaaacccattccagaattcagcgcctgctggctaaaaaaccctaatttgtgtggatatagacatgactaatgatgtttccaatactagttccattccggcattgaatgctgatttcaatatcggtggaatgttgctcaagatgggtaagattacaccgcaggatgcggagcgtatcctgcgtgtgcagaaggaaagaggcgttcgctttggtgaggctgccgagagtttgggcctagtttcctctgccgatatcaactatgtattatccaagcagtttgcctatccctacctgatggatggtcgcggcgatttctccgagaacttggtcgcggcttatgatccattcagtatcaatgtggagaagtatcgcgccattcgtagccagctcatgctctactggtttgcacaagggaaaaagagcctgtcattttccagtgtttacgacaaggacgacaccagtgacttggttgccaatcttggcgtggttttctctcaactgggagagaaaacactcatcattgatgcccatcttgatagcccacggcagaatcgcatttttaatatcaagagcactgcgggtttgtcggatattctggcaggccgggttacggattactcctcttccatcactaggctagtcgagttcgagcatctctccatcttgtcttctggcaccattccacctaatccgcgagagcttctgggacgtggtttcctcaagcagttcatcacggcaattgctaatgactacgatgttatcctggtcgatgcaccttcctttgtccgccactctgaaccgttgtctgtggcaagtgctacggaaggggtggtgcttcttgccaagcgtcatgtctccaaagccaatgacttgagcaaagtggttgatcagctttccaagatcagggtgcctgttgttggcacggtattgactgaaaactaaaatgagcttgaaccagagcattgcggtcgccagtacccagctaagaaggtaccagcatgtgataccactgctggtaggcttgctgttcttatttgtgcccacctacctgaacctgacgaacacggtctggcagatgcaggatcaggcgcatggccccttgatcctgatggtggtgctgtacctagtctgggtggacaaggaaatactgctagacacggcaaacttgagacaaagcgggcgtggtgtgggcctgttgctgtttttgtttggcctgttggtatacatcatcgggcgttcacaagatttgctggtgtttgatgtgggctcgcagattccggtattggctggcttgctgttgattttctataaggccaaaaccctcaagcgcttctggttccccttgttcttcttgttcttcatgattccattgccaggctccatgctggatgttgtgaccttgccgatgaaggtcgctgtctcttacgtggccgagcatgtgctgtattggtttgattaccccatcgcgcgttcgggtgtgatcattcagattggtcagtatcagttgctggtggcggatgcttgtgcaggcatgcataccttgatttcactggaggccctgggcctgctctacctcaatatcgtcaggcatgattccctggcccgtaacttgttgctggccttgctgattatccctatttccttctcagcgaatgtcatacgcgtgattgtgttgaccttgatcacctactatttcggggatgaagtgggccagggctttgtacatggattcgcgggtattttgttatttgtcgtggcattaaccctgattatttcagtggatagcctgatccaatactttgttggcaaacatacacagcgtaaggctagattgcagagttgatatgagcgtcagattaatcaatatcctggcagtatgcatggtggtgagttctggcctggcgttggctttgacccctgatcttagctccgtgcgggatgatccacatcttgaaagtttcgtgcctagcagctttggtcagtggcaggaagtcaaaaccaatcaggtgcagatggacctgacagtcaggagagatggcgaacccagcatcgataacccttatgatgaagttctcatgaggagttatgccaatgaaaagggtcaggtcattatgctggctcttgcctatggcaaattgcagcggcaggaagtcaaggtgcataggcctgaactgtgctatacggcgcagggtttctccatcagaaatcagcaggataccgcagtgaatgtgggggcaggcgcaacacccatcccatccaaggcgttggttgcggcttcaagacagcgcgaagagctggtgctttactggatcaggataggcgatatgatcagtaagagtgcttgggagacccgactttatattgtggagcaaggcctcaaacatcaactggtagatgggatactggtcagaacctcacagatattgggtgaagatgatgccgagcaatctttgcagctacaacaacagttcctgcacgatctggtgcaagcagtgcccagggacaagcgtaaatacttgattccatcataattttatagccttgtgtttccattaggataatggagatcgagtaaaggatttgagcataaaagctgggtatgctagcaaacagccagcaggggaattaacaacatatcttaataacagcgcaccagctctgcggcgcaagtgcgttggcatatccttgggtgttaaacctaatctgggatgacttttttggtctctgcaacaacaggcgcttgagccatctcgtcaaataatggggattgggtttgaagatattatttctaagtcacactgccgcagggggcgaatttgtagttggctcacatcaactatctaaacaattcgccttgcaagggcatgaggttgtccacctcagtccgccagtgacaccagcacatctgacactgttgcagaaaacaccgtttgagcgtgtccggtttaagcgctggatgaaagcgggtgatgtcatcaaccacgtgaccgacattattcctttctcattaataccttggggtattgccacccgcttgggatctggtagcgatatctttggttacttcctgaagttttcagcactcagacaactccgtaaacatcaattttctaatcctgacgtagtgttgattgatgagcctcgattaggctatctactcaaatatttccctaagtcaaagatcgtataccgccccactgatatttatcatgaaatcagaaatgatcccagtattgtagatgctgaaaaagggttgatatcccaggtacacggcttcattgcgacatcagagcctgtaagacagcatttgaatcgcctaggtgttgatgaggtgctattgctgcagaatggtgtagatctagatcattacctgaattttacaaaatccaaactggatttgccgcctgagccaagggcaatttatgctggagctctggatcatcgctttggttttgatgtgctgaaaagtgcagccacaaaacaccagaaaatttcatttttattggctgggccagtagaggaaaaatacaaggcggcatttagtgatcttgccaacgtacactttcttggtcatgtgcaatataaagcgttgcccaatctcttgagtcagtgccaaattggtttattgccgatgtctgatcatccatccaaccttggccgtagtcctatgaaattgtttgaatatgcagcagtcggacttcccgttgtttctacctcaacaccagagcttgagcgcagatcattaccctttgtatttttggctgagaatgcccagattttcacagataaacttggtgatgtttgcaatgcggatatcaaaatattggctcagcaggctcgagataatgctaagcatgagtcttgggcaagtaaaaccatcacaatactgaactatatttattcaaagtaaagcaatgaacaaaactactgaaccacaagatagtcaaaccaatgttccatggtggctatcccctcatggactatgcttaggctttcttttgcctatgatcttgttgatctggtggttggggtcagtgagatcaccaacattaaccatacggggttatatatatttaagttctgaatatatagctctggctgtgctaattgttgtgctgtcagcaagtgcagcctggatgggaagcttcgtcaagacaaaagtcagagtgccgccagactctcaggttaatatggctttgcgggtattaggctatgtagcagttgcagcatatatatactggttcaaagagctgattatcaatcctatgaatattattaatatatttacagggacaggtttatcaagacaggaaattggtgcaacgcaagggattacatcacttgttaacttcaccccaatatttatttcgatttacatatatgccagatatatcgccaaattacctttaagacaagatgttgtattgttgttctatgcaattgttttattgacattgctgcgggtatttgcctgggcagagcgtctggcattaattgaaattattttgccatttgcgttattgataacgcggcaacaagtgttcagtaagattaaaattttgcaattcttcattaaggctggtcccttcgcgggattgcccttgctggtgctttactttggtatggcggaatacttccgctcttggagctctacaacttacgccgggaaatcgagtttttgggattttgctctagggcggattgcttcatattattacacctcgctcaataatggtgcgggaatgctggctactgttaactggccaacatatgaattcgaaaatgtgttgaattggatgcataaatttccaatttttggcggcgtgtttcgttactacgtagatttgcacactatgagaatgggtgagtttctcgctcagtatggtgatgaggagttcaacaacccttctgggatattttcagtgatcctggatttgggcttgccatttggcattatctacttctttataaccgcatttcttgcaggaatcttttataaaggctatttgagaggcaattttttaagtgtaattttttatccgttattttttattacgttattggaaattttcagatatccgtatttaggaacgtcccgagcttttaccgagattattggtgtgattattgctttctttatagttaagggaaggactgaaaatgatagaaaatcgtagacacctggttaaatcattattcttgatgctattttcatcctggcttcccaaggtcgcctcggcagcgcctaaggtggtcgggggcaatgcagacttcactagagctttagatgacgcgcttgctggacgcacggaagtgctaagcggttattatgaaataagtaatcctttaagattttcactgaagagtggcaccgtaaaatttgcaccagattttcagctgaaattcttgaatgataaattaagtggtttagtattttcgagttgcagtgatttatcactcattggtggagatttttcgtacaaaaaccccccagctagaagaattggacatggtggtatttacgagttctctagatgtaccaaagtcatcgttagagatggattttattatgacacaccaggtacaggtatcatttttaccttatgtgatgattgtgcagtaattaaagctacggtttggaattcctgggctgatgggttgcactttgcaaattgcaataactgcatcgccttggattatcagtctaccaatacaggggatgatgggttggcgtttgtaaactacaaaaaacatcccgatgcagtaggtggttatgcgaacaacattgttatcaatggttcttatgcacgaggaattgcgattatcggtcaatctggtgtgactatagacaagtttgaaattaggcacacttccgcagaaggattaaagattggaagtgagcaatactatgacactagaattccttccaatgtgacaatcaaaaacggcattgttgaagaggcaggtacttggtgcgtggcaaaggcaactggcaatggtttcctagtccaaggtgctaccgataaaattgttgttgagaatttgactgtcaatgccccacgcgtgcatggaattgttttcgacaggcatggcggtaatgtcaaaatgaaagatatcgtcgtcaagaatacaaaagcaagtggcataaccatgatggcggataacatcgagttagtgaatggggagtttttaaatattggaacaacacctctttacgtcaataaagcattaactgctaatttctccaagattaatgtcaataccttcggattcgcagataaatcaagttggcctattttctgggctgttgaagctaagaatgtgttaattaaccaaatgaaagtggagtccaccaccttggttagaattggtgggaaaaacgttatttcacatcagataactggggtgcagatcagtggtgtgcagcttagcggactgctctctgatgggcttaattccaaaacaacatcggcggtttctgctataacatcaactgctgttaagtttattgagcagtggaattagcaagtggatgcaggtgcgagattgaggatttcatggatcgatgtctgccgtggatttgcaatgctgttggttgtggttgggcataatcagatattaatgggccaaagtctttctttggtaaaatttatttatctttttcatatgccactgttcttttttattagtggtataaccctcaagccagatcaaggattaacgtactatttcacgcgggcgattaatgttattgcggtatattttgtattttcatttttagttcttccttttgttttaatgaaaaatccagatgatggtgttttcaatatagttcttggtattttgtacggaactggacatacaatagaagttgctcctctctggtttataccatgtttatttttctctattgttttggtcggtctcgcattagttatttcaaatcattttaataacactgatcgtgaatcaaatagaagtccgatttttttccttgcattattgtttatcggagttggtgtttttctcattaactcaattcattattatttaattgataatcttgcttggggtagtctgaaaaattcaggaatgatttggagtattgatatagcaataattggtgctggctttattcttctaggtatgtacgcaaaggtatttgttgataagtacaaaattactgaaatcaaatcaatatatcttattgtatctattgtttgtgcgattttcgttatgttggggttgtttagttttggtgttgacgtcgatttgaattttagaaaaattgcgcattatcctttggctatgctctgcatgatcttaggaatatttttcagtattttgttttcaatttttctagataaatatacctacctatcaactatcttgagcagtattggtaaatctacgttattgattcttttatttcacaatgcgattcaaaatcatttaattttcacaattggtgattcaaaaatatatagtgctgtgatcggcattgttatcgcaatattgatacctatagtacttgataagtttgttgtgaataaatacgaattgttcagaaaaatagtttacccaaaactatctatcaaccttgcatccaagataatggtagggaaaagattttgattgtatatattaatggccgatttttaggaagacgcataactggggttgatcgatacgcaatagaagtattaaaagagttaaatacactgattgcggaaaatcatcccagtgtagctggtgttgaatataagattgttattcctcctcgcatcaaaactgacttgcatctaactcatatacctatagtggcttatggtttttttagtgggcatgcgtgggagcaattgtccctactaatgttgagtctgagtagtaagtcaatggtattaaatttatgtaatacaggctcaatcttcgtgcgtagtcaaatcgtcgtcattcacgatgctgcagtggtgagaattcctagtacattttctttagcatttcgggtgtggtacaaaacactcatgccagtactcggcagagtcgcaaagaaaattgtaacggtttcagaatattcgaaaaaagacattattaacttttttggtgtacatcctgaaaaagttcaagttgttggtgcaggcggcgagcatattttgtcgcaacagccagacgcaggtattcttgaaaaatttcaagttcacccgggctcttatgtgttggcggttagtagtcatgctccgcacaaaaatttttctttaaccattgaatctttaaaactttctaagaatgcaaatattccgtatttgattgcaggtggggctaatcagaaaatttttggtgaaaattcccagttagattcttctaaggtgacgttgctgggttatgtctcggataatgagttgcgcgcgctttatgaacatgcgctttgttttgtttttccatcactttatgagggcttcggtcttcctccactggaggcgatgaattgcggctgccccgtacttgcatcaaatgctgcatcaattccagaggtgtgcagtgatgctgcattatatttttcaccgcatgatccgcaggagctttcaaagcttatagataatgttgctcatgatgccgatttgagaaagtcgttagtcaaccaaggcttgaagcgagcaaaagatttttcttggaaaaattccgcaatagatattgcacggatgtgcaaggagattttcacaataaagtaatagtattatctgccaagctgaatttttctttataaagtctaggccaggcatgttgattattaactagattatgactaataaatatacgaggcattcgagattgcacccaaaaaaagtagctatcgttgtggattggcttaatgaatatgctggagcagagcgtgttctggagcagttggttctttgctatcctgatgcagacatttttgctgtcattgaattcttacctgataacctgagaggttttattcagaataagaaggttacgacaacttttatccaaaacttgcctaaagctaaaacgcattatcgcaattatttgccactaatgcctttagctattgagcagctcgatctgtctcaatatgatttgattatttctagttctcacgccgtggccaagggtgtgcttactgggccagatcaagtgcatgtaagttatgtccattctcccatgagatatgcgtgggatttgcaacatcaatacttgcgtgagtctaatttggtttcaggttttaaatcttggattgtcaaatggttgctacataaattgcgtatttgggatctaagaacggcgaacggggtagatgtttttatcgcaaactcttcttttattgctaaaagaataaagaaggtatatggacgtgaggctagggttatttatcctcctgtagataccaacagttttgcattccaggaaaagaaagatgactttttcttgactgcctcgagattggtaccttacaaacgagttgacttgattgtggaagccttttccaaaatcccagatcagaaattagttgtcattggggatggtccagacatgtccaaggtgcgtgcaaaagcagggccaaatgttgaaatcctcggttatcagtctcatgctgtgttaagagactacatgcagcgtgcgaaagggtttgtcttcgcggcggaggaagattttggtatttctcctgttgaggcacaagcatgtggtactcccgtgattgctttcgccaaaggtggcgccttggagacagttattccagaagagcgaggtgatcctgccactggtttgttcttccatgagcagacagctgatgccatcgtggatgctattactagatttaatctactctctcaaaagattagtccatttgcatgcagagagaacgcactgcgcttttctcctgatcgatttagaaatgagattatttcaactgtgaataaggctctcgattaattattttctcttacgacatatagtaagttctcatatttaattttataggatagttgctatgaaaatagctgttgcaggtactgggtatgtgggcttgtcgattgctgtgcttttagcacagaaaaatgaagttgttgctcttgatatcgtccctgataaagttgaccttatcaacaataaaatttctccaatcgttgataaagagattgagcattatcttaagaatattccattgaacctacgtgcgactacaaacaagcatgatgcatatgaaaatgcagattttgtagtgattgcaacccctacggactatgatccggttaccagctacttcaatacctcctctgtagaggcagtgatcaaggatgtccaggcgattgcgcccaacgcgaccatggtgatcaaatccaccatccctgttggttataccaaaatgatttccgaaaagttgggtgtggataacctgattttctctcctgaattcttgcgtgaaggtaaggcactttacgacaacctgtatccctcgcgtatcgtcattggtgaaatttcggatcgcgcacaagtttttgccgaccttctcaatgcaggtgctgtgaaagagaatattccggtgctattgaccaatagtgctgaagcggaggccattaagctgtttgccaacaccttcctcgccatgcgcgtcgcctatttcaatgagctggatacttatgccgccacccatggcctgaacacacgtcagatcatagatggggtgtgcctagacccacgtgtcggtgaccactataacaatccatcgtttggctatggtggttactgcctgcctaaggataccaagcaactgctggccaattacgacaacgtgccgcaaaaactcatcaatgccattgttgatgccaacaccacgcgcaaggatttcatcgcccagagcatcatcaagcgtgaccccaaggtggtgggtatctaccgcctgatcatgaaagcaggctcggataacttccgcgccagttcaatccagggcgtgatgaagcgcatcaaggcacgtggtattaaggtcgtggtgtttgagcctgagttgaaagaagatcaattcttcaattcagaggtgatccgcaatctggaagagttcaagaagatttcagacgtcattgtcgccaatagaagggcgcaggatttgtcagacgttgatgagaaagtatatacgcgtgatttgtttggcaatgactagccagattgaaaaggtgttgggttaaggatatgaggatacttttttcacctgctacggcgagtaatcagtatgtcgagaacacgattgccctgattaaaaccctagacgctacccatgtcgaaacccaagccagattgaatgctggattcatcttgcgcaatgctttcaaccgctatgattgcattatcatcaactggctggaaaacaacctggttggaaaaaacaagtcgcttgatatatgggcggtagcaaaatttctgttcaagtttttcatctacagagtcatggggagaaagttgatttttgtcaggcacaatatttatcctcatgccttgaagggtcggcaggcatccatcgcgacctggatcattgaagcggcgattaagctctcaacaatatccgttgtacattcagggcatctcgaaaatgagaacgcgaaatatgtacctcatcctttgtacagggttgattcgcaggttgaaggccaaggcagtgattattatgtaatttttggcaggattgttgcgtataaagccatccataaattactcgaaagctgggggtcgcagcggctaatcatagccggcattgtcgaggatcatgcctacgctgccagcttgcaatccatcatacagtccagagggttgagcaatgttgaactgcgtgctgaattcctctccgaagccgaggctgaacaactggtagctaacagcaagggcttgattctttcacattgcgatgccgacatgattgtcagtggtagttttttctttgctgcaagtctgggcgtgcctgtttttgccatggatactccatttttccagtggctgaagaatgagcaaggctatcagggcttgcaggtgttcacatcactgcaggcaatgacggctgagctagccactgccgcggccgtggaaaaaaatactattgctgcttcagcccagcgtttatttggcaatgatagggtgagaagtgcatggggtagtgtgctccatggttaattcaataccttatcttttgtctcacttaatattttgattgaattgcaacaatgagcaaattgatgaccacgataggtcaggatgttaaccagcctgcaggcattcctgaagtatttacaatcaatgatgtcgttgacagagggctatgcgttggatgtggtgcgtgcgcggttgtagattcaaacgtcaagctaacgcgcaatcaatatggttccatggtggccgccattgatgccaatatcctgccagggtctattgccgaccgggtatgcccattttctgataacagtcttaatgaagatgttgtgggagaacgggtttttgcgagttgtgaaaattttgatcaacgtaccggttattacaccaatttatattatggccgcaggttcactgaagctgaattgctgaaaagcagttctggtgggctgaccagttatgtcgccattgaacttctcaagcgtcatcacgtggatggcattattcatgtgggacgcgaccagtcagatgatcgcgatgctttgttcaagttcatggtgtcttacacagaagaagacgccaatgcctgcaagaaatcacaatattattccctgagttttgatgaggtagtaagaagcatacgcggagatggtaagcgttatgtatttgtgggcgtgccctgctttgtcaaatctctgagaaatatttgtctcaatgatgctgtgctcaatgagcagattccattcatgctgggcttggtgtgtggtcatttgaagtcttcgcgctttgccgaattactagcgtggcaacttagtgtgccaccggaaaaaatccagagtgtggactttagagtaaaaaataatgcctccaccgtgaattcctacgatttccaggtggtggatagcaatcagcaagcccatgcaaaaacctctaatacaatgctgggcggcaattggggccatgcggcgtttcaacttcaggcatgcgattattgtgatgatatatttgccgagacagcagacgctgtctttggtgatgcatggttgccgcagttctccacatggtggcaaggtaccaatatcgtcctggtaagaaaccctatcatcgacgacattctggaatcggggaaaaatgcaggcgccatcactctgggcggtgtcagcattgatgatttatgcaagtcgcagttgggtaatttccgccacagaaaagatggtttgattgtcaggttagacgatgacctgaagcagggcaagaaggtccccaaaaaacgggttgatctgtctgcattaggcaagattgaccagaagagaaagaaaattgtcaggctcagaaaggaaatggccgtgaaaagtcacgaatatttcctgcaggcccgagaaaagcacgatctcagcctttatatgaagcccatggggcagttggcgagaaatatgcttaagctgtatagggatccatttatgaagcgactgatcaataggctgaagcgatatttttaatattgccttaggtcaatgcgttatcactcattaatctaatttttgaatggtctagggatttgagtctatctgtaaaagccgcgcgcggtggtgtggtcatgatgtcaggacaaattgtgaaggtagctttgcagtttggcagcctgattatcttggcacgcctgttgcaaccagaagattttggtttggttgccatggtgattgcgatttatggcatttgcgacatcttgctcgactttggcctttcgacggcgtctattcaagtccaaaacataactaaagcgcagatcagcaacctgttctgggtcaatgtattgataggtctgttgtttacgctgatttcatacttttcagcaagtttactggcgagcttttatgctcagccagaattaaccaaaattgcgcagtatgtttctgtggtgtttttattcaatggtattgccgcacaatataaagcccagctgaaccgtaatttcaaattcaaacagatggcaataacagatacgactgctgttttgctcagtgtttgtatcggggtctatttcgcatatgccggacattcttactgggccatcgtatatcagcagatagcgcaggcattgatacaaatgcttttgtacatgcttttcggcgcttggctaccttccttgccttcaagacatgtttctatcagacatttcttcaaattcggttgggggctggctggttctcaattgatgggatacttctcgcgcaatattccagctatcttgattggtaatcaaataggtgccagccagttggggttttacgatagagccaacaaattactgatgttgccgctaaaccagctgaatgcgccttcatcgtcggttgctgtccctgtgttgtcacgtttggcagtggaagatcaggaaaaatacaatcgttttcttctgtttggacaaaatatcattgtccatctcgttgtattttgcctggccttaacctgctgccagacagagcgcctggtgcaattggtgctcgggacacaatggttggaaatggtgccggtctaccgggcactttcatttgcagggatatttttggcgctcagctatgccagttactgggtatttttatctaaagggattactgcctctctatttaaactaggcttggttagcaggccaatctctattttgattatttgcctggggctgcccgctggtgtgattggcgtagcgtatgcatactcggcaagtctgctctttacctggctactcggcgttttctggctgaggaaaacgggcgttcctgtcaaaagcatgattgtagatccactcatcatgtctgccatttactatagcgccagttttatcgccaattacgtggtcgatcattatgtggactttgccatatacaacattcttgtcggctggttgctgatgttgctgatcctggcagtattttatttgttggtccccaagttcaaacgtagcgtgaaaaagttatttgaagtgaaaagttatattcggaacaaacaatgaagaccattaaaaaattactatacaaaatcctaggtagtgcaggcatcaaggccaaggctgcagcagtcatcaatctcctgtttggtcgtgtggctagaagcactaatgacagtgtctctattcttattccggcaccaggaggggggaatatcggtgatcaggcaatgctggaatcatttttgcataatattgatggcaaaaaactcattatcaaaacacagcctatagcattggatattcctagtcactatgcagtgaacgttgaagtgatcgaaatgccaggattgatctacggtcatttgttcaggtttttgcgggattacgtaagactgagaaaaataatggcatctgccagcgctttgtatgtagttggcgcagatatcatggatggtggctataataaaaatgcctctatcatgcgctctaaaattgcaacttatttcgcgcgtaataatattccatccagggtgtttggtttcagttggaatggcaatcctgatgcagcagcgctttctgctatcagaaacgcagctgccaatggggttttgctttgtgcgcgagatcctctttcattccagcgtctacaagatgcaggggttcccaatatcaggctggttgcagatatggtgtttgccaatgacaacaccaaatcagctgggattgaagatattttgcaattctgcgcaggcaagcagattgctctggtaaatgccagtggattgattggcaaaaatattgatcaaattgatgaatatagcaaggtaataaacaagctgatggaccacaattttaatattgtactattgcctcacgtgatcagacacggagccaatgacttgccgatttgtcaggcattgtcaggcaagtatccgaatgctttcctagtaaatagactgttggaaccagatcaggttaagcgcttagcacaagaggctaaaattgtcgtcaccggtcgcatgcatctttccatcatgagcctgaatcagaatgttccatctatcgtattatcgacccaaggcaaggttgatgggcttatgcaattcttcgaaactgaaaaactgtcgattaatccggaaaaaggtttttccgatcttatttgttcacaaattgattttatttgttctaatcggcaatattatcaagacctgattcgtaaaaacctacttaaggttaaggaactggccgctgggaattttaattagtgtgataattatgacttatcatcgggctgctttcagggtgcaaaatagttagattccccagttaatattctataataatgtttatatgtattaatggttttcattgcattttatatctatgatatatgcacactaatgttggtgtaattttcaatatttattgattagcaggcacatcataatttattgcaagcttttactataatgatagtgatgaactgtcgaagtgttttggattatgttcacactatgtctccagggattatatgtctaaattctataaatttcaggtgttagaatcactaagaggttatatggcatggtgggttgttttaggtcatgctatccaactttctggtttttggcacaagcaagaagtagatgagttttttacaggagggggcataattaatgccactttttcaaaaatactcagtttaatcatcaatccagaacttgcagtcaacatttttattattttaagtggttttgtgattactcatttattgcttactaaaaatgagccatattcacatttcataactagacgatttttccgcttggcgcccgcattttacgtttcgttagttatcgcgattttggtagttaatttttacaaggttgcatataccggtctgagtttttctggtgatacctcgatgcgactcgccaggcttgttgagcaagatagtaattttttattgcatttattcaatcatttactcctcattcatagcgttttcccgcaagagctgattcaattttcacctaccacgtttcttgctccggcatggagcatcagtcttgagtggcagttctatctaattgcaccagtcttaattccatttttggtgaagtctgagaagtctttgattgtttgggttgtgttgttgctactgctgcgatattttaccaaccatgttttagactttaattggcaacatagctccttcttctttaaagctgtcgattatttcttggtcggcatcttaagcagattaattatcgagcgactgcagcatggcaagtttatttatgatgttgccgtgttgctaggtggaatattgcttttccaggatagatattgcgctgttatctggctgtttgttttggctgtcatattttatgaaatgggttattggagtgttaaatctcccctatggaaaaaaatcctgacattatttttctacaataaagtcatcacgaatattggtaagtggtcttattctacttacctaatccatattcctattttctcaattttcttaggtggttatgcaactctgactgaccctggcactgtaacccagcaaatttctttgattatcctatttgtcagttttccagtggttttgctgatttcaaatattatgtatcacaacatagagctgccatcgatgaattatatttccgcaaaactaaaagaaaaacgtatcactgaatctgcagagtgatggttaattctcttattgcatgctggaataattattctttcaatgtgagtgccatatttttttaatgttattaatttatcgttttagagattttaattatattttctatttgattttttaatgcaagatttttatctattaaacaattaattattgattggaatgaaaaatgaaaattgttcctgtattactctccggtggttctggtacacggttatggccactttctcgagcggtattacctaagcaactgttgcccttgatcactaataaaaccatgctgcaggagacccttctcagaatttcaagatgggcgactgtaacaaatccagttgttgtttgcggtaacgatcatcgattcttagtggctgaacagttgcgcgaaatcgctttgagtcctaactctattattctagagcctgcccccaagaatactgcaccagctattgccgctgcagcattgcagctacaaggtcaggatgtttatatgctggtcttgcctgctgatcatgtcatcagggatctgcaaagttttgaacatgctgtgcaaaccgcattgactgccgctgatcaaggtaacttagtcaccttcggtatcaaacctgctcatcctgaaaccggttatggctacatcaaattaggcgttgagagcgcaccaggatcttataaggtcaatcgttttgttgagaagccagatcttgccacagcaactgaatatgtggcgtcaggtgagtttttctggaacagtggcatgtttttattcaagccagaaactttcctcaagcaactggaaatccatgcccccgaaattactgctgcagtaagcaaggccgtcaataacagttataaggatctggatttcgtcagattagaagaatcgagttttgctgagtctccgtccttatccatcgattatgcggtaatggaaaaaaccgatcatgctgttgtagtgcctgctgatattggttggagtgacgttggctcatggacgtctctacaagaggtgcaagagcaggatgccaatggcaatgtagctcgtggcgatgtttacctcaagaatgtcgagaacagtctggtgcggagtgaggataggtttgttgccgcgattggtgtccgtgatctgatcgtggtggagaccagtgatgccgttctggtagctagcaaggatgctgcacaagatgtcaaggaggtagtggaatacctcaagttaaatcaacgctctgagcacaagatacatccacgggcctacaggccttggggttggtatgaaagtattgatctgggcgagcgccaccaggtgaaacgtatcatggtgaagccgggcgaaaagctgtccctgcaaatgcaccaccatcgtgccgagcattgggttgtagtcagtggttcagccatgattacggtggatgggaataccaagctattcagtgaaaatcagtcaacgtacattccaattggctccacccatagattggagaatccgggcaagttgccgctgcacttgatcgaggttcagtccggaagttatctgggcgaagatgacattgtgcgttacgaggatacctacggccggtcctgataagaaaagcgtcgtcctcaggctagtgtcatgc

SEQ ID NO: 178 - DNA, 26292 bp, Methylobacillus glycogenes
gcatgacactagcctgaggacgacgcttttcttatcaggaccggccgtaggtatcctcgtaacgcacaatgtcatcttcgcccagataacttccggactgaacctcgatcaagtgcagcggcaacttgcccggattctccaatctatgggtggagccaattggaatgtacgttgactgattttcactgaatagcttggtattcccatccaccgtaatcatggctgaaccactgactacaacccaatgctcggcacgatggtggtgcatttgcagggacagcttttcgcccggcttcaccatgatacgtttcacctggtggcgctcgcccagatcaatactttcataccaaccccaaggcctgtaggcccgtggatgtatcttgtgctcagagcgttgatttaacttgaggtattccactacctccttgacatcttgtgcagcatccttgctagctaccagaacggcatcactggtctccaccacgatcagatcacggacaccaatcgcggcaacaaacctatcctcactccgcaccagactgttctcgacattcttgaggtaaacatcgccacgagctacattgccattggcatcctgctcttgcacctcttgtagagacgtccatgagccaacgtcactccaaccaatatcagcaggcactacaacagcatgatcggttttttccattaccgcataatcgatggataaggacggagactcagcaaaactcgattcttctaatctgacgaaatccagatccttataactgttattgacggccttgcttactgcagcagtaatttcgggggcatggatttccagttgcttgaggaaagtttctggcttgaataaaaacatgccactgttccagaaaaactcacctgacgccacatattcagttgctgtggcaagatctggcttctcaacaaaacgattgaccttataagatcctggtgcgctctcaacgcctaatttgatgtagccataaccggtttcaggatgagcaggtttgataccgaaggtgactaagttaccttgatcagcggcagtcaatgcggtttgcacagcatgttcaaaactttgcagatccctgatgacatgatcagcaggcaagaccagcatataaacatcctgaccttgtagctgcaatgctgcagcggcaatagctggtgcagtattcttgggggcaggctctagaataatagagttaggactcaaagcgatttcgcgcaactgttcagccactaagaatcgatgatcgttaccgcaaacaacaactggatttgttacagtcgcccatcttgaaattctgagaagggtctcctgcagcatggttttattagtgatcaagggcaacagttgcttaggtaataccgctcgagaaagtggccataaccgtgtaccagaaccaccggagagtaatacaggaacaattttcatttttcattccaatcaataattaattgtttaatagataaaaatcttgcattaaaaaatcaaatagaaaatataattaaaatctctaaaacgataaattaataacattaaaaaaatatggcactcacattgaaagaataattattccagcatgcaataagagaattaaccatcactctgcagattcagtgatacgtttttcttttagttttgcggaaatataattcatcgatggcagctctatgttgtgatacataatatttgaaatcagcaaaaccactggaaaactgacaaataggataatcaaagaaatttgctgggttacagtgccagggtcagtcagagttgcataaccacctaagaaaattgagaaaataggaatatggattaggtaagtagaataagaccacttaccaatattcgtgatgactttattgtagaaaaataatgtcaggatttttttccataggggagatttaacactccaataacccatttcataaaatatgacagccaaaacaaacagccagataacagcgcaatatctatcctggaaaagcaatattccacctagcaacacggcaacatcataaataaacttgccatgctgcagtcgctcgataattaatctgcttaagatgccgaccaagaaataatcgacagctttaaagaagaaggagctatgttgccaattaaagtctaaaacatggttggtaaaatatcgcagcagtagcaacaacacaacccaaacaatcaaagacttctcagacttcaccaaaaatggaattaagactggtgcaattagatagaactgccactcaagactgatgctccatgccggagcaagaaacgtggtaggtgaaaattgaatcagctcttgcgggaaaacgctatgaatgaggagtaaatgattgaataaatgcaataaaaaattactatcttgctcaacaagcctggcgagtcgcatcgaggtatcaccagaaaaactcagaccggtatatgcaaccttgtaaaaattaactaccaaaatcgcgataactaacgaaacgtaaaatgcgggcgccaagcggaaaaatcgtctagttatgaaatgtgaatatggctcatttttagtaagcaataaatgagtaatcacaaaaccacttaaaataataaaaatgttgactgcaagttctggattgatgattaaactgagtatttttgaaaaagtggcattaattatgccccctcctgtaaaaaactcatctacttcttgcttgtgccaaaaaccagaaagttggatagcatgacctaaaacaacccaccatgccatataacctcttagtgattctaacacctgaaatttatagaatttagacatataatccctggagacatagtgtgaacataatccaaaacacttcgacagttcatcactatcattatagtaaaagcttgcaataaattatgatgtgcctgctaatcaataaatattgaaaattacaccaacattagtgtgcatatatcatagatataaaatgcaatgaaaaccattaatacatataaacattattatagaatattaactggggaatctaactattttgcaccctgaaagcagcccgatgataagtcataattatcacactaattaaaattcccagcggccagttccttaaccttaagtaggtttttacgaatcaggtcttgataatattgccgattagaacaaataaaatcaatttgtgaacaaataagatcggaaaaacctttttccggattaatcgacagtttttcagtttcgaagaattgcataagcccatcaaccttgccttgggtcgataatacgatagatggaacattctgattcaggctcatgatggaaagatgcatgcgaccggtgacgacaattttagcctcttgtgctaagcgcttaacctgatctggttccaacagtctatttactaggaaagcattcggatacttgcctgacaatgcctgacaaatcggcaagtcattggctccgtgtctgatcacgtgaggcaatagtacaatattaaaattgtggtccatcagcttgtttattaccttgctatattcatcaatttgatcaatatttttgccaatcaatccactggcatttaccagagcaatctgcttgcctgcgcagaattgcaaaatatcttcaatcccagctgatttggtgttgtcattggcaaacaccatatctgcaaccagcctgatattgggaacccctgcatcttgtagacgctggaatgaaagaggatctcgcgcacaaagcaaaaccccattggcagctgcgtttctgatagcagaaagcgctgctgcatcaggattgccattccaactgaaaccaaacaccctggatggaatattattacgcgcgaaataagttgcaattttagagcgcatgatagaggcatttttattatagccaccatccatgatatctgcgccaactacatacaaagcgctggcagatgccattatttttctcagtcttacgtaatcccgcaaaaacctgaacaaatgaccgtagatcaatcctggcatttcgatcacttcaacgttcactgcatagtgactaggaatatccaatgctataggctgtgttttgataatgagttttttgccatcaatattatgcaaaaatgattccagcattgcctgatcaccgatattcccccctcctggtgccggaataagaatagagacactgtcattagtgcttctagccacacgaccaaacaggagattgatgactgctgcagccttggccttgatgcctgcactacctaggattttgtatagtaattttttaatggtcttcattgtttgttccgaatataacttttcacttcaaataactttttcacgctacgtttgaacttggggaccaacaaataaaatactgccaggatcagcaacatcagcaaccagccgacaagaatgttgtatatggcaaagtccacataatgatcgaccacgtaattggcgataaaactggcgctatagtaaatggcagacatgatgagtggatctacaatcatgcttttgacaggaacgcccgttttcctcagccagaaaacgccgagtagccaggtaaagagcagacttgccgagtatgcatacgctacgccaatcacaccagcgggcagccccaggcaaataatcaaaatagagattggcctgctaaccaagcctagtttaaatagagaggcagtaatccctttagataaaaatacccagtaactggcatagctgagcgccaaaaatatccctgcaaatgaaagtgcccggtagaccggcaccatttccaaccattgtgtcccgagcaccaattgcaccaggcgctctgtctggcagcaggttaaggccaggcaaaatacaacgagatggacaatgatattttgtccaaacagaagaaaacgattgtatttttcctgatcttccactgccaaacgtgacaacacagggacagcaaccgacgatgaaggcgcattcagctggtttagcggcaacatcagtaatttgttggctctatcgtaaaaccccaactggctggcacctatttgattaccaatcaagatagctggaatattgcgcgagaagtatcccatcaattgagaaccagccagcccccaaccgaatttgaagaaatgtctgatagaaacatgtcttgaaggcaaggaaggtagccaagcgccgaaaagcatgtacaaaagcatttgtatcaatgcctgcgctatctgctgatatacgatggcccagtaagaatgtccggcatatgcgaaatagaccccgatacaaacactgagcaaaacagcagtcgtatctgttattgccatctgtttgaatttgaaattacggttcagctgggctttatattgtgcggcaataccattgaataaaaacaccacagaaacatactgcgcaattttggttaattctggctgagcataaaagctcgccagtaaacttgctgaaaagtatgaaatcagcgtaaacaacagacctatcaatacattgacccagaacaggttgctgatctgcgctttagttatgttttggacttgaatagacgccgtcgaaaggccaaagtcgagcaagatgtcgcaaatgccataaatcgcaatcaccatggcaaccaaaccaaaatcttctggttgcaacaggcgtgccaagataatcaggctgccaaactgcaaagctaccttcacaatttgtcctgacatcatgaccacaccaccgcgcgcggcttttacagatagactcaaatccctagaccattcaaaaattagattaatgagtgataacgcattgacctaaggcaatattaaaaatatcgcttcagcctattgatcagtcgcttcataaatggatccctatacagcttaagcatatttctcgccaactgccccatgggcttcatataaaggctgagatcgtgcttttctcgggcctgcaggaaatattcgtgacttttcacggccatttcctttctgagcctgacaattttctttctcttctggtcaatcttgcctaatgcagacagatcaacccgttttttggggaccttcttgccctgcttcaggtcatcgtctaacctgacaatcaaaccatcttttctgtggcggaaattacccaactgcgacttgcataaatcatcaatgctgacaccgcccagagtgatggcgcctgcatttttccccgattccagaatgtcgtcgatgatagggtttcttaccaggacgatattggtaccttgccaccatgtggagaactgcggcaaccatgcatcaccaaagacagcgtctgctgtctcggcaaatatatcatcacaataatcgcatgcctgaagttgaaacgccgcatggccccaattgccgcccagcattgtattagaggtttttgcatgggcttgctgattgctatccaccacctggaaatcgtaggaattcacggtggaggcattattttttactctaaagtccacactctggattttttccggtggcacactaagttgccacgctagtaattcggcaaagcgcgaagacttcaaatgaccacacaccaagcccagcatgaatggaatctgctcattgagcacagcatcattgagacaaatatttctcagagatttgacaaagcagggcacgcccacaaatacataacgcttaccatctccgcgtatgcttcttactacctcatcaaaactcagggaataatattgtgatttcttgcaggcattggcgtcttcttctgtgtaagacaccatgaacttgaacaaagcatcgcgatcatctgactggtcgcgtcccacatgaataatgccatccacgtgatgacgcttgagaagttcaatggcgacataactggtcagcccaccagaactgcttttcagcaattcagcttcagtgaacctgcggccataatataaattggtgtaataaccggtacgttgatcaaaattttcacaactcgcaaaaacccgttctcccacaacatcttcattaagactgttatcagaaaatgggcatacccggtcggcaatagaccctggcaggatattggcatcaatggcggccaccatggaaccatattgattgcgcgttagcttgacgtttgaatctacaaccgcgcacgcaccacatccaacgcatagccctctgtcaacgacatcattgattgtaaatacttcaggaatgcctgcaggctggttaacatcctgacctatcgtggtcatcaatttgctcattgttgcaattcaatcaaaatattaagtgagacaaaagataaggtattgaattaaccatggagcacactaccccatgcacttctcaccctatcattgccaaataaacgctgggctgaagcagcaatagtatttttttccacggccgcggcagtggctagctcagccgtcattgcctgcagtgatgtgaacacctgcaagccctgatagccttgctcattcttcagccactggaaaaatggagtatccatggcaaaaacaggcacgcccagacttgcagcaaagaaaaaactaccactgacaatcatgtcggcatcgcaatgtgaaagaatcaagcccttgctgttagctaccagttgttcagcctcggcttcggagaggaattcagcacgcagttcaacattgctcaaccctctggactgtatgatggattgcaagctggcagcgtaggcatgatcctcgacaatgccggctatgattagccgctgcgacccccagctttcgagtaatttatggatggctttatacgcaacaatcctgccaaaaattacataataatcactgccttggccttcaacctgcgaatcaaccctgtacaaaggatgaggtacatatttcgcgttctcattttcgagatgccctgaatgtacaacggatattgttgagagcttaatcgccgcttcaatgatccaggtcgcgatggatgcctgccgacccttcaaggcatgaggataaatattgtgcctgacaaaaatcaactttctccccatgactctgtagatgaaaaacttgaacagaaattttgctaccgcccatatatcaagcgacttgttttttccaaccaggttgttttccagccagttgatgataatgcaatcatagcggttgaaagcattgcgcaagatgaatccagcattcaatctggcttgggtttcgacatgggtagcgtctagggttttaatcagggcaatcgtgttctcgacatactgattactcgccgtagcaggtgaaaaaagtatcctcatatccttaacccaacaccttttcaatctggctagtcattgccaaacaaatcacgcgtatatactttctcatcaacgtctgacaaatcctgcgcccttctattggcgacaatgacgtctgaaatcttcttgaactcttccagattgcggatcacctctgaattgaagaattgatcttctttcaactcaggctcaaacaccacgaccttaataccacgtgccttgatgcgcttcatcacgccctggattgaactggcgcggaagttatccgagcctgctttcatgatcaggcggtagatacccaccaccttggggtcacgcttgatgatgctctgggcgatgaaatccttgcgcgtggtgttggcatcaacaatggcattgatgagtttttgcggcacgttgtcgtaattggccagcagttgcttggtatccttaggcaggcagtaaccaccatagccaaacgatggattgttatagtggtcaccgacacgtgggtctaggcacaccccatctatgatctgacgtgtgttcaggccatgggtggcggcataagtatccagctcattgaaataggcgacgcgcatggcgaggaaggtgttggcaaacagcttaatggcctccgcttcagcactattggtcaatagcaccggaatattctctttcacagcacctgcattgagaaggtcggcaaaaacttgtgcgcgatccgaaatttcaccaatgacgatacgcgagggatacaggttgtcgtaaagtgccttaccttcacgcaagaattcaggagagaaaatcaggttatccacacccaacttttcggaaatcattttggtataaccaacagggatggtggatttgatcaccatggtcgcgttgggcgcaatcgcctggacatccttgatcactgcctctacagaggaggtattgaagtagctggtaaccggatcatagtccgtaggggttgcaatcactacaaaatctgcattttcatatgcatcatgcttgtttgtagtcgcacgtaggttcaatggaatattcttaagataatgctcaatctctttatcaacgattggagaaattttattgttgataaggtcaactttatcagggacgatatcaagagcaacaacttcatttttctgtgctaaaagcacagcaatcgacaagcccacatacccagtacctgcaacagctattttcatagcaactatcctataaaattaaatatgagaacttactatatgtcgtaagagaaaataattaatcgagagccttattcacagttgaaataatctcatttctaaatcgatcaggagaaaagcgcagtgcgttctctctgcatgcaaatggactaatcttttgagagagtagattaaatctagtaatagcatccacgatggcatcagctgtctgctcatggaagaacaaaccagtggcaggatcacctcgctcttctggaataactgtctccaaggcgccacctttggcgaaagcaatcacgggagtaccacatgcttgtgcctcaacaggagaaataccaaaatcttcctccgccgcgaagacaaaccctttcgcacgctgcatgtagtctcttaacacagcatgagactgataaccgaggatttcaacatttggccctgcttttgcacgcaccttggacatgtctggaccatccccaatgacaactaatttctgatctgggattttggaaaaggcttccacaatcaagtcaactcgtttgtaaggtaccaatctcgaggcagtcaagaaaaagtcatctttcttttcctggaatgcaaaactgttggtatctacaggaggataaataaccctagcctcacgtccatataccttctttattcttttagcaataaaagaagagtttgcgataaaaacatctaccccgttcgccgttcttagatcccaaatacgcaatttatgtagcaaccatttgacaatccaagatttaaaacctgaaaccaaattagactcacgcaagtattgatgttgcaaatcccacgcatatctcatgggagaatggacataacttacatgcacttgatctggcccagtaagcacacccttggccacggcgtgagaactagaaataatcaaatcatattgagacagatcgagctgctcaatagctaaaggcattagtggcaaataattgcgataatgcgttttagctttaggcaagttttggataaaagttgtcgtaaccttcttattctgaataaaacctctcaggttatcaggtaagaattcaatgacagcaaaaatgtctgcatcaggatagcaaagaaccaactgctccagaacacgctctgctccagcatattcattaagccaatccacaacgatagctactttttttgggtgcaatctcgaatgcctcgtatatttattagtcataatctagttaataatcaacatgcctggcctagactttataaagaaaaattcagcttggcagataatactattactttattgtgaaaatctccttgcacatccgtgcaatatctattgcggaatttttccaagaaaaatcttttgctcgcttcaagccttggttgactaacgactttctcaaatcggcatcatgagcaacattatctataagctttgaaagctcctgcggatcatgcggtgaaaaatataatgcagcatcactgcacacctctggaattgatgcagcatttgatgcaagtacggggcagccgcaattcatcgcctccagtggaggaagaccgaagccctcataaagtgatggaaaaacaaaacaaagcgcatgttcataaagcgcgcgcaactcattatccgagacataacccagcaacgtcaccttagaagaatctaactgggaattttcaccaaaaattttctgattagccccacctgcaatcaaatacggaatatttgcattcttagaaagttttaaagattcaatggttaaagaaaaatttttgtgcggagcatgactactaaccgccaacacataagagcccgggtgaacttgaaatttttcaagaatacctgcgtctggctgttgcgacaaaatatgctcgccgcctgcaccaacaacttgaactttttcaggatgtacaccaaaaaagttaataatgtcttttttcgaatattctgaaaccgttacaattttctttgcgactctgccgagtactggcatgagtgttttgtaccacacccgaaatgctaaagaaaatgtactaggaattctcaccactgcagcatcgtgaatgacgacgatttgactacgcacgaagattgagcctgtattacataaatttaataccattgacttactactcagactcaacattagtagggacaattgctcccacgcatgcccactaaaaaaaccataagccactataggtatatgagttagatgcaagtcagttttgatgcgaggaggaataacaatcttatattcaacaccagctacactgggatgattttccgcaatcagtgtatttaactcttttaatacttctattgcgtatcgatcaaccccagttatgcgtcttcctaaaaatcggccattaatatatacaatcaaaatcttttccctaccattatcttggatgcaaggttgatagatagttttgggtaaactatttttctgaacaattcgtatttattcacaacaaacttatcaagtactataggtatcaatattgcgataacaatgccgatcacagcactatatatttttgaatcaccaattgtgaaaattaaatgattttgaatcgcattgtgaaataaaagaatcaataacgtagatttaccaatactgctcaagatagttgataggtaggtatatttatctagaaaaattgaaaacaaaatactgaaaaatattcctaagatcatgcagagcatagccaaaggataatgcgcaatttttctaaaattcaaatcgacgtcaacaccaaaactaaacaaccccaacataacgaaaatcgcacaaacaatagatacaataagatatattgatttgatttcagtaattttgtacttatcaacaaatacctttgcgtacatacctagaagaataaagccagcaccaattattgctatatcaatactccaaatcattcctgaatttttcagactaccccaagcaagattatcaattaaataataatgaattgagttaatgagaaaaacaccaactccgataaacaataatgcaaggaaaaaaatcggacttctatttgattcacgatcagtgttattaaaatgatttgaaataactaatgcgagaccgaccaaaacaatagagaaaaataaacatggtataaaccagagaggagcaacttctattgtatgtccagttccgtacaaaataccaagaactatattgaaaacaccatcatctggatttttcattaaaacaaaaggaagaactaaaaatgaaaatacaaaatataccgcaataacattaatcgcccgcgtgaaatagtacgttaatccttgatctggcttgagggttataccactaataaaaaagaacagtggcatatgaaaaagataaataaattttaccaaagaaagactttggcccattaatatctgattatgcccaaccacaaccaacagcattgcaaatccacggcagacatcgatccatgaaatcctcaatctcgcacctgcatccacttgctaattccactgctcaataaacttaacagcagttgatgttatagcagaaaccgccgatgttgttttggaattaagcccatcagagagcagtccgctaagctgcacaccactgatctgcaccccagttatctgatgtgaaataacgtttttcccaccaattctaaccaaggtggtggactccactttcatttggttaattaacacattcttagcttcaacagcccagaaaataggccaacttgatttatctgcgaatccgaaggtattgacattaatcttggagaaattagcagttaatgctttattgacgtaaagaggtgttgttccaatatttaaaaactccccattcactaactcgatgttatccgccatcatggttatgccacttgcttttgtattcttgacgacgatatctttcattttgacattaccgccatgcctgtcgaaaacaattccatgcacgcgtggggcattgacagtcaaattctcaacaacaattttatcggtagcaccttggactaggaaaccattgccagttgcctttgccacgcaccaagtacctgcctcttcaacaatgccgtttttgattgtcacattggaaggaattctagtgtcatagtattgctcacttccaatctttaatccttctgcggaagtgtgcctaatttcaaacttgtctatagtcacaccagattgaccgataatcgcaattcctcgtgcataagaaccattgataacaatgttgttcgcataaccacctactgcatcgggatgttttttgtagtttacaaacgccaacccatcatcccctgtattggtagactgataatccaaggcgatgcagttattgcaatttgcaaagtgcaacccatcagcccaggaattccaaaccgtagctttaattactgcacaatcatcacataaggtaaaaatgatacctgtacctggtgtgtcataataaaatccatctctaacgatgactttggtacatctagagaactcgtaaataccaccatgtccaattcttctagctggggggtttttgtacgaaaaatctccaccaatgagtgataaatcactgcaactcgaaaatactaaaccacttaatttatcattcaagaatttcagctgaaaatctggtgcaaattttacggtgccactcttcagtgaaaatcttaaaggattacttatttcataataaccgcttagcacttccgtgcgtccagcaagcgcgtcatctaaagctctagtgaagtctgcattgcccccgaccaccttaggcgctgccgaggcgaccttgggaagccaggatgaaaatagcatcaagaataatgatttaaccaggtgtctacgattttctatcattttcagtccttcccttaactataaagaaagcaataatcacaccaataatctcggtaaaagctcgggacgttcctaaatacggatatctgaaaatttccaataacgtaataaaaaataacggataaaaaattacacttaaaaaattgcctctcaaatagcctttataaaagattcctgcaagaaatgcggttataaagaagtagataatgccaaatggcaagcccaaatccaggatcactgaaaatatcccagaagggttgttgaactcctcatcaccatactgagcgagaaactcacccattctcatagtgtgcaaatctacgtagtaacgaaacacgccgccaaaaattggaaatttatgcatccaattcaacacattttcgaattcatatgttggccagttaacagtagccagcattcccgcaccattattgagcgaggtgtaataatatgaagcaatccgccctagagcaaaatcccaaaaactcgatttcccggcgtaagttgtagagctccaagagcggaagtattccgccataccaaagtaaagcaccagcaagggcaatcccgcgaagggaccagccttaatgaagaattgcaaaattttaatcttactgaacacttgttgccgcgttatcaataacgcaaatggcaaaataatttcaattaatgccagacgctctgcccaggcaaatacccgcagcaatgtcaataaaacaattgcatagaacaacaatacaacatcttgtcttaaaggtaatttggcgatatatctggcatatatgtaaatcgaaataaatattggggtgaagttaacaagtgatgtaatcccttgcgttgcaccaatttcctgtcttgataaacctgtccctgtaaatatattaataatattcataggattgataatcagctctttgaaccagtatatatatgctgcaactgctacatagcctaatacccgcaaagccatattaacctgagagtctggcggcactctgacttttgtcttgacgaagcttcccatccaggctgcacttgctgacagcacaacaattagcacagccagagctatatattcagaacttaaatatatataaccccgtatggttaatgttggtgatctcactgaccccaaccaccagatcaacaagatcataggcaaaagaaagcctaagcatagtccatgaggggatagccaccatggaacattggtttgactatcttgtggttcagtagttttgttcattgctttactttgaataaatatagttcagtattgtgatggttttacttgcccaagactcatgcttagcattatctcgagcctgctgagccaatattttgatatccgcattgcaaacatcaccaagtttatctgtgaaaatctgggcattctcagccaaaaatacaaagggtaatgatctgcgctcaagctctggtgttgaggtagaaacaacgggaagtccgactgctgcatattcaaacaatttcataggactacggccaaggttggatggatgatcagacatcggcaataaaccaatttggcactgactcaagagattgggcaacgctttatattgcacatgaccaagaaagtgtacgttggcaagatcactaaatgccgccttgtatttttcctctactggcccagccaataaaaatgaaattttctggtgttttgtggctgcacttttcagcacatcaaaaccaaagcgatgatccagagctccagcataaattgcccttggctcaggcggcaaatccagtttggattttgtaaaattcaggtaatgatctagatctacaccattctgcagcaatagcacctcatcaacacctaggcgattcaaatgctgtcttacaggctctgatgtcgcaatgaagccgtgtacctgggatatcaaccctttttcagcatctacaatactgggatcatttctgatttcatgataaatatcagtggggcggtatacgatctttgacttagggaaatatttgagtagatagcctaatcgaggctcatcaatcaacactacgtcaggattagaaaattgatgtttacggagttgtctgagtgctgaaaacttcaggaagtaaccaaagatatcgctaccagatcccaagcgggtggcaataccccaaggtattaatgagaaaggaataatgtcggtcacgtggttgatgacatcacccgctttcatccagcgcttaaaccggacacgctcaaacggtgttttctgcaacagtgtcagatgtgctggtgtcactggcggactgaggtggacaacctcatgcccttgcaaggcgaattgtttagatagttgatgtgagccaactacaaattcgccccctgcggcagtgtgacttagaaataatatcttcaaacccaatccccattatttgacgagatggctcaagcgcctgttgttgcagagaccaaaaaagtcatcccagattaggtttaacacccaaggatatgccaacgcacttgcgccgcagagctggtgcgctgttattaagatatgttgttaattcccctgctggctgtttgctagcatacccagcttttatgctcaaatcctttactcgatctccattatcctaatggaaacacaaggctataaaattatgatggaatcaagtatttacgcttgtccctgggcactgcttgcaccagatcgtgcaggaactgttgttgtagctgcaaagattgctcggcatcatcttcacccaatatctgtgaggttctgaccagtatcccatctaccagttgatgtttgaggccttgctccacaatataaagtcgggtctcccaagcactcttactgatcatatcgcctatcctgatccagtaaagcaccagctcttcgcgctgtcttgaagccgcaaccaacgccttggatgggatgggtgttgcgcctgcccccacattcactgcggtatcctgctgatttctgatggagaaaccctgcgccgtatagcacagttcaggcctatgcaccttgacttcctgccgctgcaatttgccataggcaagagccagcataatgacctgacccttttcattggcataactcctcatgagaacttcatcataagggttatcgatgctgggttcgccatctctcctgactgtcaggtccatctgcacctgattggttttgacttcctgccactgaccaaagctgctaggcacgaaactttcaagatgtggatcatcccgcacggagctaagatcaggggtcaaagccaacgccaggccagaactcaccaccatgcatactgccaggatattgattaatctgacgctcatatcaactctgcaatctagccttacgctgtgtatgtttgccaacaaagtattggatcaggctatccactgaaataatcagggttaatgccacgacaaataacaaaatacccgcgaatccatgtacaaagccctggcccacttcatccccgaaatagtaggtgatcaaggtcaacacaatcacgcgtatgacattcgctgagaaggaaatagggataatcagcaaggccagcaacaagttacgggccagggaatcatgcctgacgatattgaggtagagcaggcccagggcctccagtgaaatcaaggtatgcatgcctgcacaagcatccgccaccagcaactgatactgaccaatctgaatgatcacacccgaacgcgcgatggggtaatcaaaccaatacagcacatgctcggccacgtaagagacagcgaccttcatcggcaaggtcacaacatccagcatggagcctggcaatggaatcatgaagaacaagaagaacaaggggaaccagaagcgcttgagggttttggccttatagaaaatcaacagcaagccagccaataccggaatctgcgagcccacatcaaacaccagcaaatcttgtgaacgcccgatgatgtataccaacaggccaaacaaaaacagcaacaggcccacaccacgcccgctttgtctcaagtttgccgtgtctagcagtatttccttgtccacccagactaggtacagcaccaccatcaggatcaaggggccatgcgcctgatcctgcatctgccagaccgtgttcgtcaggttcaggtaggtgggcacaaataagaacagcaagcctaccagcagtggtatcacatgctggtaccttcttagctgggtactggcgaccgcaatgctctggttcaagctcattttagttttcagtcaataccgtgccaacaacaggcaccctgatcttggaaagctgatcaaccactttgctcaagtcattggctttggagacatgacgcttggcaagaagcaccaccccttccgtagcacttgccacagacaacggttcagagtggcggacaaaggaaggtgcatcgaccaggataacatcgtagtcattagcaattgccgtgatgaactgcttgaggaaaccacgtcccagaagctctcgcggattaggtggaatggtgccagaagacaagatggagagatgctcgaactcgactagcctagtgatggaagaggagtaatccgtaacccggcctgccagaatatccgacaaacccgcagtgctcttgatattaaaaatgcgattctgccgtgggctatcaagatgggcatcaatgatgagtgttttctctcccagttgagagaaaaccacgccaagattggcaaccaagtcactggtgtcgtccttgtcgtaaacactggaaaatgacaggctctttttcccttgtgcaaaccagtagagcatgagctggctacgaatggcgcgatacttctccacattgatactgaatggatcataagccgcgaccaagttctcggagaaatcgccgcgaccatccatcaggtagggataggcaaactgcttggataatacatagttgatatcggcagaggaaactaggcccaaactctcggcagcctcaccaaagcgaacgcctctttccttctgcacacgcaggatacgctccgcatcctgcggtgtaatcttacccatcttgagcaacattccaccgatattgaaatcagcattcaatgccggaatggaactagtattggaaacatcattagtcatgtctatatccacacaaattagggttttttagccagcaggcgctgaattctggaatgggttttatttttgtcgatcacacccagcagcggtgcgccaacaatctctaccagcactctttctgagcgaattcgctcattagtgagctcagccaacaaactaaacaacaagccaaaaattgtacccagcaccaacgcaactgccacgttcaatatttttttcgggcttgatggcttaagtggtggtgtcgctggattaaggatggatacatcagcttgattagactgtccctcaagatttatttgagtatatcgctgagtcgcgagttcgtaagcgcgttgcgcaccctcgacttcacgcgtcaataccgtcagtgcatccctatccttgttcaacagcatgaccttggttttttgctcagccaaggcattgcggatttcactctcgcgttgcttaaggattctataattgctcgatatattgacggtagccgcctggatttgcttacttaattcagacttcagattgtcaagctcagctttggccccctgatagagtgggtgatttctctcatatttttgtgagatatccgcgaagcgtgattcagacctagcaatctctgttttcaggtgcagaaccattggattactcgcgacatccggagatccataagcattgctaccttgtgcaccagtctgacgagactgtgcctcaagagtttgcccttgtgacatcactaactgcgaggaaagttcattcagcttggcacgttcaatgtctagacgctcatcaacgctgacgatgcttttatcttgttggtaatcggaaagcttttgctgcgcccgggtaatatcggcacgcaaatccttcaattgcccggtataaaattcagccgcctttttcgaaggctcaaccttgagttcgatagtggccttgatatattcctcggcaaaggagttagcaacaacagcagcaaatttggggttggctccatcaaactccagctgcaacacactactgttgcgcgcaggttgaacttcgatacgtgagatcagcaaatccgccaaccaatcaacgatatcaccttcaccacctgtggagtcattgaaactctccacaacctcactactttcattgagctttaatgtggtcacaaccctcttagcaattttcttgctagttatgatatccacctgggtacccatataacctggaagcagctgggcagggacagccataccagtcacaggatctacacctttatagttgactaggatactggtggttgccttatagctgtttggcaagaaaatattgagcgcaattgctacgaccagggccacaacaatggtgcttaacaatatcttatatcgcgctttgaatatcagtaaaagttgagaaaagctcattagattaaccttgcctatcaagtatttattaaaatctgcaatctattaaaagaaactttcctgcacatagatcacatcgttgggcttgatgaggtcatcatgtttggcagtgattacttcaatatggccgctagcatcacgacgcttgatcttgacgcctttttctgtgccgcgagggcttaagccaccacctacagaaagcgcttgcaatactgtcatttcatgttcgagacggtaatggctggcacgttgaacctgaccatagatatagaatttatcgaaacgttcaacataaatgatgtcaccaccagctacgcggatgttcttgctgagatcgccagtacgcatcatgtcagcaaggtcaatctgatccctgaccgctttaccatcgacgttatgcaccagcgtgatcagatcgccaccttcaggtgatacaccaccagccaaggcaagcacatccgccagcgttttagcgctatctatagggtatctgcccgggcgattgacttgacccagaatagagacttgaaggctctgcaattgcgcaacgatgatgttgacgtgagcactcttaaggaaaccacccttttccagcatggtggcaattctttgctcggcggcggcaaccgtaccaccacccacacgcacttcacctatcaggggataagtaatggaacctgattcactcactctgacctcaagtgacagatcaggctgctcgaacaccgatattttcagcacatcgccagcgccgagaagaatgtcaccttctgcagcatgcgttacaaaaggcgtcagactcagcatcagcaagaaaaaccatgtcattaattttttcattttactatcgtcctgatattaaggatggggagtacttatttcaagccactaacaccactggcgatatcatcctcagtagagcttggcttctttttggctgccttggtttcagtcgctgtttccatctttttatcgatgtactcaatcttggcatcggctttcaagcgcttgacttcattttcagcaacttccttgcgcgccttattcagcaaattgttttcaatttgcggtgttgcttctgcaagtgaaactgggctgtccttgatctcgttcatcatgatcaacatggtgcgagggcccatgccgatcacgaacaacttacccttatcctcggccttgaggcgctcggaaatctgtggcggcaattcagcaacactgcgtgaaacctgaccttgatcgtactgaatattatgggcatccatccatgcggctacttcctgcaaggtcttgagtttgccaagtgctgttttcaattcatcattggcgaatttagtatcaatcaacaattgatccatttccaccattctgcgcttgctgaagaattgaggattctcgttataaaaattctcaatttctgttttgcttggcttggcgacactgcctaacttggattgcagatatgcctgagcaatgatttgtgatttcgcacgttcaatcgtggtcatcacatttggatccctatccaccttggccttgagcgcagcttcttcaagtaactggcgatctatcaatgcagtcagaatctgctgcgttgcctgctcgcgctgattctcctgaatgttggcacgacccagctcctgattcagctgatgtacggtgatttccttgccattgaccttaaccagagactggctggctttggattcatgcttgtcgccacagcccgacaatgcgaaagcgagcacaatcacagcaccgacacacagggttctggattgcttgaagttagttacaaatccgttattcactttccaatctcctcaaatctatttaaacaacctagtaggcgttatcttttttgaacacaaccagcaccgtcctgacgataatccagaagtcaaaagccagggaccaatggcgcaaataatccaagtcatactcgatacgggactccatcttgtccaaggtatcagtttcaccacgtaaaccattcacctgcgcccagcctgttattccaggcttgaccttgtgccgcagcatatagccacgaatcagcttgcgatattgctcattatgagaaacggcatgcggtctaggccccacgatactcatctgaccttgcaacacattgatgaactgcggcagctcatccagtgagttcttgcgcaagaaaccaccaatcggtgtcaatcgctgatctcgcttctgcgcctgtactaccttgtcaccatcttccattactttcatggagcggaatttatagacaatgatttcctcaccattcagcataacgtcgctgcttgaaaatcaccgggcctggggaggtcaacttcacggccagagccagtgtcagcatgatgggagacagcattaatagaataagcgacgccaaaataatgtcactagtccgtttgattaaactgttgaaaccggtgaatggcgtctcaagaatagcgaccacaggcacaccagccacatcatcaaagcgcgcttgtaccagatcaaaaatatagatatccggcacaaagtaaatagatgctgtggtgtcttgcaattcttcaaataactgcctgatgcgtggctgcgccgacatgggcaggctgatgaaaataatctgggtattattggcgcggacatatggcgcaatttccgacatggaaccaagcaaaggcagattacgcatgcccttggggtgcctggcgacctctctgtcgtcaaagatccccttgacctccataaacaggtacgggtcgtccgtgatgcgattgatcaagcgcacgccaatatcattggcaccgataatcactacggacctgacttcaccattcttgtgcaaatccgaggcaattttgcgtatcgccagatgcgtgacaataaatatcatcggcacactggcaaaccaggcatatatcatctcatccagatactgactggatagatcagcggcatagccgatgaacatcagcacagcgatgacaataccccagccaaagagaatatcgcggatataaccaagtatcttgccactacgccaggtacggtaaagatccagacgctcgtagacattagaggaaacaaagtaggctagcaacgccagaatcaggtagtagccattaaaaggctcaccaaacaacagggtgaacacatacagcgtaccaagaatgatcagcgggtcgagcagctgcttgaaaaacgctactaaagggatgtcatttacggtcatttatcttacaccatcagaattcataacgaccagtaagcgaaatgcttgtcgagttgtagtttaaaattggtgaggttgagtcacgcaaacttctatttagaccagtagtgaaacttaacgattcaagagggctgtacgttaccccaaaagaaaaaaccttattcttgtcggtacgaccttgatcttgcccggtgatatcgccttcaaattttagttgttgatacctggctgaagttgacagcaggatcttactcgttgcgctataggagatgcttgcacttgcgccactatcaatcacatagctggcagttacgattgatatagcatttgcatcgcgccatgcggctgtcttgaaagaggttttgtcggtaatggaccacaccatgttcccgtgggcattaaatccggaaaaatcgcgctgtgagaagctgtcatgtttacgatcaacatacccccccaaaaattcaaatcgtgttttggcagaataaagccaaagtatgtccgccttgagtgattgctgcctgtagtcattattgacaaacacggtaccaatccccgggaaaaaagcaggcctatcaaagggccgcgtgccacgcccattagtgaagaccaagccaaccttactgcctgactcagctaaatagtccaaacctacgtgctgggaattttcctgaaaagaagccgcattcaatgtttgagagtcatactcaacatcctggcgctgcacaccaaagcgcgcgcgccaactggaatggaaacgccagtttgcttcaaaagttttacgctcctgaatacgcatattcaattccacaccacgaaaatccgcaaaaggcagcatagcctcgtttttatagtactcaaccttgccccggaattgcgagcccactgcccagttccatcgagcgacaatatctttacctgtattgtctaactctgaatttttgttgtatttggtttcattcacaccgatattggcgtagaaattctgctgactaatatccttatccagaataatgccaacccggcccactacactcgtatcggactccttgtcagagcggcgcctcaggttgtcatcataaacatatgttgcactgacatagggccgtatgacatcaccttcacgagccagcacagggtcggaataacccactgcattccaacctatgactgccgtgataaccagctttttataatgagtagagtctgttagtcgcaaagaaatacttccccaatggctaccagtaatgccagttaccggtatagataatccaaactcccaatacaccgttggtcaccgcatgcgcgatgatcggcatccatattgttctgctccggatgtaaagcaatccgtatgccagccccgcaaccagaccagcaaaccataggttatgctctatggcaaaaagtagtgaagaaaccagtaatgccacagcaccaaccgtggccggctccaccttgaggaagtcctgattttgtatccagcgcatcaggaaagaacgccagaacaactcttccatcagaggcactactagggcagcaccgacaattcttgtcaccattaggagacacgcttcgacaccctgccccggattgaagccttgcgatggcccgcccagtaacatccacggggcatccaggttaatccaagcgacaaatactagcacaccaatgctgattgcgctcaaccacgacttcaaactaagcaacgacaagccaccaagctcgatatagtgtttgcgcaatgtccaaagcaagtaggcaaccaagccaaccttgactccatataaccatcgcagatcaaaaccctcaggcacaactgcgccgatcaggtctacccctgccatgaatagcatatagaccgcgaagggaataacacggctacttatcggccccagtgatgccctgttcatgcatgtgccttagtttgaaatacgctcatgatacaaaatcaaatcgccaaatgacaggcattctcatttcaatagtccctatggactaaatcagactcactcactgcatgaatggccttgcggatgctactgtgcaactgctatagatttatgacaagtcttgtcacaccttcgctcgccattcccagtatgtgctacaacttcaggaataggcaccaacacaatacccaaaatgaataagtcggcatgaagccgacttattcatttactcttagcatgactaaatgcacgcctgataagcgcgtgcatttacgtgctcagcttaattaagcttggcgacgacgtgcagcaaagcccagcagtcccagaccaaccagcatcaat

SEQ ID NO: 179 - DNA, 26076 bp, Methylobacillus glycogenes
atgttaaaaaaagtagctctaattacaggtatcactggacaagacggagcatatctagctgaatttttacttggcaaaggctatgtagtacatggcattaagcgccgagcatcacttttcaatacagatcgcattgatcatctgtatcaggaccctcacgtcgataaccagaatttcatccttcattatggggatttgacagattccaccaaccttatacgtatcattcagcaggttcagcccgacgaaatctataacctcgcggcaatgagccacgtggcagtcagttttgaaagtcctgaatatacggctaacgcggatggtcttgggactttgcgtattctggaagctatccgcatcttggggctggaaaagaaaacccgcttttaccaagcctcgacctcagagctttatggtttggtgcaggaaacaccgcagaaagaaagcaccccattttatccacgcagcccgtatgcggttgcgaagctttatgcatattggattactgtcaattaccgcgaagcttatggcatctacgcctgtaatggtattttattcaatcacgagagccccttgcgtggggagacctttgttacccgtaaaattacccgtgccttggcgcgcatcaagctgggcttgcaagattgcctttatttgggaaatctggacgcgttgcgtgattggggtcacgccaaggattatgttgaaatgcaatggctgatgttgcaacaggaacaggcagaggatttcgtcattgcgacaggtgtgcaatacagtgtgcgcgatttcgtcaatgcagccgcccacgagctggatattgccatcacctggaaaggtcagggccaagaagagatgggatacgacggtcaaggcaggtgcattgtacaggttgacccgcgctattttaggcctaccgaagttgaaacattgcttggtgacccgagcaaggcaaagcaaaaacttggctggtcgcccagcatcagtttccaggagttggtttctgaaatggtgcgtgaagatctcaagagcgcagagcgtgacgaactggttaagcagcatggttttgctgcctatgactataacgagtaacctgagcctatggacaaacacgcacgtatctatgtggcagggcatcgaggcctagtgggttccgctatcgttagggggctagagggcaagggctatagcaatcttatcaagcgtacccatgcagagcttgacctcacagatgctaatgccacggaagcattctttgctcagtatcagccgaatatgttttcctggcggcagccaaagtgggtggcatagtggccaataacacttacccggcagattttatccgtgacaatctcgcaattcagaacagtgtgatccatagtgcctggaagcatggagtaaagcgcctattgtttttagggtccagctgcatataccccaagcatgctcctcagcccatgcatgagcaccactttctaaccggatcgcttgaagctaccaatcgtgcatacgcgctggcaaagattgctggagtcgaaatgtgctggagttataaccggcagtatggcactcgatttcttgcagcaatgccgacaaatctttatgggcctggcgataactatcacttgcagaatagtcacgttatccctgcattgatacgcaaattccacgaggctaaacaagctgggcatgcagctgtatcggtctggggtactggaacacccaggcgcgaatttctttacagtgaggatatggcagatgcctgtatattcttgctgaatctgcctgaggagaaattcaattctctgctgggaagtgatgagagtgctactggtgtgtttgatccaccactagtcaatatcggtattggagtcgatatttcaatacaggaattggccgaattggtaaaaaaggtggttggttaccaaggagcaattgagttcgatagttcaaaacctgatggcacgatgcgtaagcttatggatgtaagcaagctcaacagtttggggtggacttattccattgagcttgatgatggattggaaaagacatattcggaatttttaacaaaataaatctgagtttattaatttatttctgatatcgaattgatattatcctcaaaaatagcgtttagataatttatataacctcgataatttttaaaatttaatgttcaattttgaaaaaaaaagtgtttgctttgattcctgccagagcaggttctaaaggagtgccaaaaaaaaacctgaaaaatatcgcaggttctccattaatagcttacacaattaacgctgctaaaaaagctaaaaatgtcgatgctgtttatgtatcttctgattgtaaagaaatattggagtattcaaaagcacaaggctgcagttcaatattaaggccgcaagaatacgcaacagatgatgcgtcagctgttgatgttgtcaagcattttattagtattgaaaatatagaggatggagatttaatcgtttacttacagccaacctccccattaagagatgaacatcatattgatgatgctttgacggctttgaataataatggccttacttctttggtcagtgtggaagtcttggataagtcgccatataagtcatttcgtctagatgataatgataaattgatttcattatttgatgaaaaattatctaattatcgtcgtcaagatttgccattatgttacgcgccaaatggtgctatttatatcttttcgaaatttgaatttgaggctagaggcggtttcccctccaatggtagtgttgcttatattatgtctgctgaagaaagtgttgatattgacaccgaagaagattttttagaaacagaagcattattaaggaaaaaatatggcatcttttgaaatttctgggcggaaaattggggacggacatgagcctatagttattgcagaaattggcatcaatcacgagggttcattagatcttgcgattgatatggcaaaagctgcaattgatgctggggcagagataataaaacatcagacacatgtggttgaagatgaaatgtctgatgaagccaagagtgttattcctggaaatgcggatgtttcaatctatgagattatgcaacgttgctcattgtcagaggatgatgaatataagctcatgcaatatgtgcagcagcaaggcagtatttttattagtacgccattctcgagaatggcagcaaatcgactgagaaaatttgatataccggcttataaaattggatctggcgagtgcaataattatcctctcgtgcggcatattgcttcatttgggaaacctattattgttagtaccggtatgaatagcattgaaagcattgcaccaaccgtcaatatattaaggcaagcaaaagttccttttgctcttctgcactgcacgaatatttaccctacccctcctgagcttgtaagacttgatgctatccaagtcattaaaaatgcatatcctgatgcggttgtgggactttcagatcacacccttgggaattacgcttgcctaggggctgttgcactaggagcctcaattcttgagcggcattttactgactccatgtcacggccgggaccagacattgtttgttcaatggaccctgcagcattgcaagatttaatcactggttcaaaagttattttttcagcaaaaggtgcacataaaggtccacttttagaagaagaaaaaactatagcttttgcttttgcatctgtcgttgcaattaaggatatcaatgttggtgatgtcttaagtgaagataatatttggttacgtaggccaggtggcggtgattttaatgcttctgactatgatcagctacttggtcgtaaagcatcgcaaactatactgagtggcaaaagagttaatcggcaggatattgaggcatgagtaggcgagttgtttttcttactggaacaagagcagattttggaaaactgaaatccctcatgcgagcattacaaaatgacatgggatttgacgtccatgtgttcattactggcatgcatatgttgtcgaaatatggttatacatgtgaagaagtagaaaaagccggatttaaaaacctatttcgctttatcaatcaaaatcaaagcgatagcatggatcatattctggccaaaacaattactggtttatcagattatgtaaaagaaatttcaccagaactgattgtgattcatggggatagagttgaagcgttggccggagccgctgttggcgcattaaataacattcgagtggcacatattgagggcggagaggtctctggcactgttgacgagttgattagacatgcggtgaccaagctgtcccatgggcattttgtttccaacgaacaggcaaaaaatcgacttattcagcttggagaaagtgaagaatccatttttgttattggctccccagatattgatgttatgaattcaacatcgctgccaagcattgatgatgtgagggaacgttatggcttctcgttcgaacattacggcattttgatgtatcaccccgttacctctgagttagatgatttgccaagacaagccaaagccatcgtagattatatttcagaaagctctctaccattcattgttgtatatcccaataatgatcatggttcagacattattttgaatgagtatttgcgattgaaaaacttgagccacgttagagtttatccatccattagatttgaatattttttaacgctgctaaaaaaatgcagcgttcatcatgggtaactctagcgctggagtaagagaggctcctcatttcggcgtgccagccatcaatgttggtagcaggcaacacaatagagcaacagcagagtcgattcttaatactactgcacatgtggattcccttagacatgctgttcaacaagttgcagacattcctcgcgtggcagtttctgactttggtaatggtaatagtgcaggtgagtttcatcagattctgttgaataatgctttttgggataagggcatacaaaagcactttatcgataggagtgcagtgtgaggttgatcgcaaggctagatgtcaaaaatgaacatgtgattaaaggcatacacctagagggcttgcggaaagttggcgatccaatcgagatggcgaaaaactattatgcacaaggcattgatgagattgtgtttatagatgcggtagcgagcttgtataaccgtaataacctgctgtctgtaatcgccaaggcttcggaagaagtttttgttcctatcactgtagggggggggctgcgttccttagcagatgtcgagatggctctgagtgccggagcagacaaagtggcagtgaatacagctgcaatacttaacccgaaattcatcacagagattgccaagcgctatggcagtcaatgtgtggttgcctctattcaagccaaacggataggcaatgactgggaagcttatatggaagccgggagggagcctacgggcaaaaatgttgttgcttggagcaaggagctggaagatcttggtgcaggcgagattttgctaacgtctatagaccaagatggtacaaaaaaaggatttgaccttccattgcttggtgcagttaacacgatagtgaacattccagtcatggttagtggtggctgcggtaatcctgatcatgtgcaagagttaaaagaaatccagccaagtggagtttgtctggcgtcagtattgcattacaaaatcaatacgatagatgaattcaaacagcgtctgacattcatcaatggtactaaataaatgaagaaaatatgtattcttgattatgggctaggcaatgtgcgtagtgtgagtaatgcgatcaagtacgtaggtgctcatcctgtaatctcaaatacgccagaggcacttaaagattctcacgcgttaatagtgccaggggttggtgcgtttgctcaaggcatgtctgcattgggtaaagatggattacaagctagcttgctcgaatatataaaaagtggaaaacatgtcttggggatttgtttgggcatgcaattgcttttcgacaggggtgaggagtttggcgttaccactggtcttggacttgtgcctggcgtagtctccagaattgtacccgtagagcaatcacgagtgaggttaccgcatatatcctgggcgaaagttgatctcaattccgttcatgaaaataatggcggcatgtttgatggactgccagacgagcagcgtaagttctattttctgcacagttatgccgctcaaaatgtacctgatcgatacatcacaggcagcgcgacgtattctggatgtacttttgttgcatcagtgcagaaagacaatatctggggtatgcaatttcacccagaaaaaagtgggcccagcgggttacaggttcttaataactttgtacaaaacagttaattgaaaagaagtgtggaggaagttgtggttaatgcatattttggtttgccggaagatgtagtgttttgcaagaaatgcgtgatttccaaccaaagacccagttctacagttgaattcaagcataccaacaaggacaaaaaagcgaccataggatttggcgctgatggtatttgtgatgcttgccgctatgcagaaaccaaggatgctcaaatagactggcaggcccgcgaggacgctttggttagattgttggatcaacatcgccgtagcgatggtggatatgacattgtcgtgcccggcagtggtggtaaagacagtgcatatacctcacatatccttaaatataaatatggtatgaatcctttaacagtgacgtgggcgccgcataagtacactgagattggttggaagaattttgaaaactggatccataaaggtggattagacaatattctttttaccccaaatggcaagttgcaccgctatttaacaaaaatggcatttctgaatttattgcacccattccaaccattcattgttggccaacgcattatcgggccgttgatggctaaaaagtttggtatcaaattggtaatgtatggtgaaaatcaagctgaatatggcaataagacagaagaaaactataaaccgacaatggacaagaattttttctctatttcagacccagctgacatggtgttaggtggtgtgaaggttggagacattattaaagacggtgaatacagcttaaatgatttcgcgccatatattccgcctgctgcagaagatctagagcgcgatggtatcgaggtacattatttgggctattacctgaaatgggatccacaagagtgctattactatgcagtcgagcatactggtttccaggcaaatacggaacgcactgaaggaacctactccaagtacagtagtatcgatgatcgaatagatatgttccactactttactaccttgatcaaattcggcattggtagggcaacatatgatgctgcgcaagaaattcgcaacgataaaattacgcgagaagaaggggttgctctagttcataaatatgatcaagagtttccaaaaaagtactttgcagaattccttgaatatatagagatcaccgaagcacagttttgggaaaccgtagataggtttagatctccacatttgtgggaaaagcaagacagtaattggatactgaagcatcaggtgacctaagaatgaaagtgttgcagataggaagtttctccggaaatgtcggtgacattgccaaccattatggttttcgcaattggtttcaaggactgcttggagagattcaatgggatgaattcgaaatacgcaatgtttaccgaaaaaatgttgcctttgacgataattttgtagctattgcaaatcagtacgatcttatagtcgtgggaggtggtaattttttcgagctatgggttgattcttctccaaccggcacctcaatctcaattgagattgaggtttttaaaaaaataaaagtccccatctttttcaatgcattgggtgttgatgatggtatgggatgtagtgatgaaagtcttgcaaagtttactaatttcttagaaatcttaacttcatcaaagcaatatttggtcagtgttcgtaatgatggagcaatgggcacgctcagaaatcggatttctaataatcccatgttggataaagtcttaccattgcctgacggtgggttttttgtaaatctggataagttagaaaaagacattgcggaaaatgatcatgaaaacactcagatcaccatcggcatcaatctggctggagatatgttggaaacaaggtttccaggtggaattaatggatatgattactcaggatttatatccgagttcaccgagactttggctgaaatgtggaataaaaataaattaataaagtttattttttttccacatatttatagtgatcttaaagtatatgccgacatactatcacggttgcctgatgcatgtagacgtgaaaatgtcaaagtggccagttacgatactaatgtgaattttcaagggacattattttccgaatatagcaaatgtactttgatacttggtatgcgatttcatgccaatgttgtagccatagctaataaaattccagtaataggattgtactcatacaagcaaattaaagaattgttttatgagttgggaataaaagaaaaaattgttgatgtcagacaaataggttttaaaaatgaattgttgagaaagtgcaatattgttattgaaaattcatctatatctcgtgatgagagctgtaacatacttgatgttgtcacaaaaaaacgtgatttgattgctccaagggtagtggagtggttacgtgagcataagcttaaatgattaattgttgtaattgtatgcttagttattatgattaaaagccttgattatctaagggcgattgcagcactaacggtttttctcagccacacctttcaaatttattggttaccaaccattggattggtgtcctggaaatatgagttgaatcattttttgagtgaaaccgcggtcctcttattttttgtattaagtggctatgtaatttcgaatagtttgcatagcaatactcaacgtaatggagggcgtctttcagtacttgattacgcatctagcagattattgcgcatatatcctcctctcattgtaagcataataatatctttagttgcctatagtgtgattgtgatctttgaactaccgggatcagtgggtactttaaaggcaccaggagatatctatcaggcaagagactacttgagcattggtacgcgagacattgtcaattctttattgatgaataatggcttgttgcaaatgaatgggccattatggagtttatgcattgaggctaagctatatttttatgcttgtttagttgtaataatttttattcattataaacaaaaaaatttgctcaattttattgctaatactggttttctcgtattatctgtattcttgttttttaatacaaaaaccgatatttattatggcttatggtggttgagcggtggtgtaattttcttatatcgtcgaaatttcataaagttcatgactttggttgttgtaatggctattgtggtgtttgctatggcagtgattggacagaagttcgtttctttgccagtgcaagttatatttgtatattctttatttttggcagcaataaaatgcaaagtgccagaaattaaggcaatgaatattttggccaatacttcgtacactttatatattgtccatttccctatgttgttactatcgtacgccatcttctcatataactttgatgtgtacggtagcctgactagagagttgatgtcatcattatcgctaataatcatcttaactatgtcaatttatattggaaaatgggtagagcgtccagctaatttacgtttgacctatcacaggttgttgagaaaagtaaaagtatgaaagccatgttttattctttgcatgcagctatttggttacatgcgcttcctgaaagccggttggcatcacagctgagtaatgccggccatgagttagtatatgtgacctgtgataaaagctttactcattattgcactggtatgagtgctttcaatcttgcattgaatgaggattttaaaaagaaaagtgcaatttgtgagttatgtattaataacgccaataaaataaccaagtcttttgattgcaagcatcttaaattgcatgattatattgatcagaaaactaatgctctgattgataacctattgaaaagtgtcacggaagataatttcctcgaatttcattatgaagatataccagtagggcgtttggctacatatgagccacttcttaagtataagaaaatgtctttggaatttagagatgaacaatggcaagatctacagattcaccttaggaatgccctggtatcgttaatcggttttatccaaatattcaaacaagagtgtccagaaaaaattttcttttatagtccacagtatggtgttaatggtgtgtgtgcagaatatgcagtaaaacaggggagacaggcatattttatagaaggtagctctagcaatgctgaacgatatagtgctttaagggtgtgggagtggagtaaatttaaattagtaaaccctgcattgcagcattggcaagctgttaaaaatttagtaacgcttgaagatattgatagagtctctgcacatattcacgaattattcaaaggtaaatcttttgctgttttttcagcgccaaaaacaggaaatttttcaatccgtgaaaaattcaatattccacagaatgctaaaattctactcgcctcattaagtagttttgatgaagcgtatgcggcttttgttatcaaaggttttcctgagcgtaaagttaaaagtccggttttctcagatcagtttgaatggattaagtgtacaattaattttatgaagtctaggcctgatgactatcttgtaattagagtacatccgcgagactatcctaataaacgcgattccaatcagtctgagcaagcattgatttgggaaaaaatacttcaggatctccctgagaatgttaaattaaactcaccagatcagaatatttctttatacgattttctcgatgatgtacatgcgctggtaacagggtggtctgccactggtgtagaagcattgctacatggcatacctgtgattacctatgataaatacttaccttcctatccggcggatatacatctaacgggagagtctgaacatgagtattatgacaaccttatcaaagtactttctttggcaacatcaacagataatacacatgtagttaatgcctatcgctggctcgcggtcagtttttcactgggcactgtcagagttaatcagccactggagattggtctgagttggccggataagccggcgtatagaatattgaaaagggtggctaacaagttttcagttaatttgcgaaaaagctacgacgtatggaatgtccagtccaacgacacagaccgtttaagatttttaagtctggttcttaataatcaatctagcctttttgagggtgtaatatctgatgtggtcgatgctgtttccgattatgaaattgaagctacggtaaaacaacattcgatataagttaattatctgatatttaatacaatttatatttagtaacacttaccattaaaatgaaagttgttgaataaattgccacaagcaaaatatatttttaagttattaaaatttgctttcaataacaacccattgttgtatttgagtgttttaatttctatactttctataggtattgaattgttggcaatggcaagcctattgcctttatttgaacttgtttcaggagaaacagtagataagcatggtttgatttcaaaagctctgattatattggggtttacagttgatgctgccagccttttgcaagttttcttcttattgttcactttgagagtagtcacgcaactatttagtcaaagcctgacgcactaccttggaagacgtgtgatggctcagctcggttctagggcttttgaaaaaatcattacttcgatgtcaattgataaaatatctgaaaaaagtataggtttttttatggggcttgctggagatgaatccttcagggcgagtactctggttgttgcattgactcagtttgttgcaacatttttactgggggtaatgtattttatttctattgcaatttattcactatatgccgccgaaatgattttcattttaatgcttgtgtctgccgtattcttcatttggattttaaaaatatctcataagatgggcgtgaggcaaatagaaggttcaaggaaagcaaattccattttcatggatgcgatgaacaatatcaaagcagtaagatcactttcttccgagaagtatgttgccggtttgtataggcgaaagatttttacgtatgcaaatattcttttttaccttgatgcaataaatctggctacgaagttagtaccaataatatttctattactcggatctttggctttgatattgagtggctgggtttctgttgaaaacttagggatggcttacattgtgtcattgatagcttatctcatgcgatttttcccagttgttggtcagagtatcactctagctgttcgcattgttgcagatgcgaaatcgggaaaagatgtgacggaattagtttccgatgaaagtgccgagagcgctaattcagacaactatttacacaagatagatacaatcaagattgataatttgtcgttttcataccgtgatgttcaaggcgtaaggccagcggttctcaattctgtttactacgagtttgaaaagaacaactcttatgctttagtggggaaatctggtttaggaaagtctactttgctggatgttttgctgaagttttatcctcctgcttcaggcagtatttcaatagatggtatttcaacagaaaatatccctggagcacatatcaggcattctattgtacttattaatcaagaacctgcgatttttgatgatacggtctacaacaatatttgtatgggcgagacttttactctagaggacgtaaaatgggcttgcgaattagcttgtatttctaaagatgtggaaagtcttgcgcaaggttatgaaacacgtttgcaatatcaaggaaaaaatctttcaggtgggcagcgtcagcgtatagctattgccagagcattagtgcgcaaacctaatgtgctgatacttgatgaaagtacaacagctttagataaggctacacaagaaattgtgatacggaatcttatgaatgagtatgaaaataagatcattatatttgtcagtcatgatccttatatcatgtctcaagtcgatcatacagttgatttggcattaatcaataaagtataaatttatgtctatctcaagtattgctttaaaaatatttaattattcgcaagagattttttcattttaccgggatagaggcttatataaattctcttatgcgcaagagggggaagatttaattctgagtagaatttttgaccgaacctctactgggtattatattgatataggtgctcatcacccagtaaggttctccaatacttatttattttataaacgtggttggaggggagtttgtatagatccctcacacgaggctattgctttgtttaaaacacggcgcccagcagatattgccttggaaatgggggtatctgatcatgagtctgagctgacttatcatatgttcgatgagcctgctctcaataccttcagtgaggaattggccaatcagcgtatacaaaacactgcttataaacgcgtcggtacccgcaaggtgccagtaagacccttgactaaaattttggatgaagtgctgctgccggatactgaaattgatttcatgagtatagatgttgaaggctttgattaccaagtgcttgcctctaacgactggtcaaagtacaggcctcgtatagttctggcagaagcacttgatgatgtcgctggcgaacgcatacgcagtttcatgattcaaaatcattacaaagtcatagcgcgtacattcaacactgagttttatcaagatcttttgaaactgtaagtaaccatgtccaatctagcacctgttgccctgtttacttataaccgccctgaccatactaaaaggacgattgaagcactgaagaataataccttgtctgctgaaacggacttgctgattttttctgatgctgcaaaaaatattacacagcaaagcatggtggatgctgtcagagcgtttactcacactgttgaaggcttcaagtcagtaagaatcatagaacgtcaaacgaattttgggctagctgcttcgattattgatggtgtaacaaatgtacttgcagagtatggtcgcataatagttcttgaagacgacatggtcaccagtccatattttcttcaatacatgaatgatagcttgagtcagtatgctgattttcatgaagttgcaagtattcatgcctatgtttatcccatcgcaggattgcccgatactttctttttgcgtggtgcagattgctggggctgggctacatggagggatagatgggattggtttgaaccagatggaagtaagttgtttgcgcaactgaagcagcttaacttgctgaataagtttgattataacggtagttatccattttcaaatatgttgcgcgaccagattgcaggaaccaataattcttgggcaatacgttggcatgctagtgctttcttgcttaataagttgacgctttatcctggtaaagctttgcttagtaatattggacatgatggatccggtgtgcattgtggagaaagcgaaacatactctgcggagttgagagctgaccgattactattgactgatattccattgcgcgagtctgagccggcatttaagaaatttgagcaattttttcttgaaagcaaaccatcagttgttcgcaaaatgatgctgaaggcaaaatccgtatttaaaaaatttttatgagttttatcaagatcctaaaattattatgccccccactttttctgcatattctgcagaagtataggcggcgtaactttgcctcttcgttcgccggaaattattcttcttgggcgcatgctaaacaaaatagtggtggctatgatgcggaaaatattctcaccatcattcaagagtcagctctcaaagtcaagcgtggtgaagcggtttttgaacgagattcagtatgtttccatcatgttgagtatagatattccgctttgtctggattgctatacgcagctgttagttctggtggcaagttgagtgtcctggattttggaggctctctggcaagtttttattctcagcatgctgcaatattgtctatagttaaggatttgcgttggggagttgttgagcagccacattttgttgcctggggtcgcgagcacctaaccacaactgatcttaaattttacaatagcctcacagagtttattttggatggaaaacccaatgttatttttctttccagcgtcctgcaatatttggagcatccataccagctgttagaagaattattgaggctagattctgagtttattcttttcgatcgcacggctttttatgacgttgttgaccgcttaactgtccagacagtgcctgcatcgatttatccggcaagttaccctgcctggttcatttcttgggacaaatttataaatactatgagtgcaggagggtatgaggtcatcatggagtttccttgtgcagacctgacggacataggctattacaaagggctttttttcaagcgcaagagtgtaagttgattttctaacaagcaattgttcatctttgagttactgtgtcttatttcttctaatgtacgggttgattctcttgttgtgaaattgttaaggtaattgtatgaatgatgaactgtactcaggtaagaatattcttgttactggtggcttgggttttattggttcaaacttggtcaaaagattaattgcgcacaaagccaaggtgaccgttgtagatagcctgttacctctttatggtggcaatgcctttaaccttagtggctatgaatcgctggtcaatatcaacatcagcgatgtacgtgatagtcatgccatggcttatcttatcaaaggcaaggattacctttttaaccttgctggacaaactagccatttggattccatgaccgaccccaggacggatctggatatcaatgccgcagcacaattatccattctggaagcatgccgacagcataatcccgatgtcagaatagtcttcgctagcaccagacagctttatggcaagcctgagtatttacctgtagatgagtcacacccgattcagccagtggatgtgaatggcatcaataaattggcaggggagtggtatcacattctctataacaatgtttacggtatcaaagcctgtgcgctacgtctgacaaatacatatggtcctggcatgcgcgtcaaggatgcccgtcagacttttcttgggatttggttgcgtagagtgattgaaggcaagccaattgcggtatttggagatggcttgcaattgagggatttcaattacgttgatgatgtggtggatgctctgttactggctgccgccaatacagaagcagatgggcaaatatttaatctcggcagtgatgaggttgtaaatttacagcaagtagctgaattaatgacacaatttcagcctggttccagctatgagattgtgccattcccacctgagagaaaagccattgatatcggtgactactatagtgatttcaataaaatcaagcaggttttaggttggagcccccgtgtgggcttgcaacaagggcttgctgcaagcctggcatactatcgccagcatcatgataaatattgggacaacgtatgattttaatgaatgacttcaaggctgaaccagaagctttgattgcagcgcagctgcaagccgtcgagcgtgtgctgcgctccggttggtatgtattaggtgaggaggggcgcaagtttgagtcattgtggtctcagcgttgcggcacttctcatacagtgggtgttggcaatggcatggatgcgattgagataggattgcgcgcgctggacattgggcccggtgatgaggtgattaccactgcgatgacggcttttgcctctgtgctggcgatcatacgtgcaggtgctacgccggtcttggccgatattgatcctgacactggcttattgagtcatgaaagtgtcaagcgatgcatcaactcgcgaacgaaagcggtcttgctagtccatctatacgggcaaatcagggatatgcaatcctggctgaacttgtgcgatcagcatcaagtggctttgttggaagattgtgctcaagcacatttggcgcaagcggaaggtaaagtggcggggagttttggtcgctttggtgcttacagcttttatccgaccaaaaacctgggcgccattggcgatggaggggctttggtaacatctcaatctgcgctggcagacaaggctgcagtgttaagaaattatggccaaagtgtgcgttaccatcatccagagtttggcttgaatagtcgtcttgacgaaattcaggcggccttgctcacggtaaggctagagtggctggaacaatatacaagtcataggcaatcaattgccgctcaatacaggcagcagttgaataatccatacgtgcgcctcatgcaaactccaacagagccattagcccatgtctatcatttgtttgttgtgctaacggagcaccgtgaagcattgcaggctcacttgcaggcaaatggcgttcaggcattgattcattatcctgtgcctattcatcatcaggaaaagtgcagcgatatattgagagatccggctgggctgcaatttagtgaggcccatgcacagcaatgcctttcgctgccatgtcatcctcaaatgtctgaacaagatgttcagaccgtcattgctgcagtcaataggtttgcactgtaaacatggagcattttgtcacactgtttgatagcaagtttctgcctcaaggtttgtgcctgcatgagtcgctggcccgccatgccagggattttcatttatggatagtctgtatggataaagtggtgcatgagcaactggaaaaattgcagttgcctcatgtttcgcttatgcgcttggccgattttgaaagcgaggcattattggccgttaaaccaggcagaacaaagggggagtattgctggaccataaccccattcactgccgaatgggtgtttgctcaacacccagaggtggcacgagtcacttatcttgatgcagatttattttttttcaacgatcctgcgatactttttcatgagtttgaacaaagcggcaagcatgtgatgattactgagcatgcatatgcacccgattacattcagcatctggaaacgagtggacggttttgtgtgcaattcatggtatttgatcgaagtgaagcatcccgtaaagttatgcattggtggcaagatcgctgcgtggagtggtgttttgcaaggatggaggatggaaagtttggtgatcagaaatatttagatttatggcctacaatttttgccgatgatgtccacatattgaagtgcgttgaacaaacgttggcaccttggaatgtagactatcaacttcagcaccaaagtgggaaattcaagccggttttttaccactttcatgcattccgcataatcaagtttaatcttgtcagactttatgaagggtaccagatagctaaaagttctcgttacctctatgacgagtatcttgcgactttgcagaaaaaaattgggatgttgcatcggtttgccattccgttgccattgttgccagaaaaatgtggtattaggccaaaattggcttcttattacacatggatcagaggatttaccgctacagctaagatcaaataaaatgcaaaaacttagtgtgattacggcaacatataatgccgctaaaaatttaccagatttagtgcaaagcctgcttagtcaaactgatatggatttcgagtgggtcgttgcagatggcggttcaagtgacgaaactatatcttatctaaaaagcgttgtaggcattaatcttttgctgtcagcgcaacaggattttggtatatacgatgcattaaatcgtgcgatttcgctaagctcaggcgattattatttggtcttgggtgccgatgatattttgtatccacatgctgtcgaggcgtttaagcgtgcggctggcataggtctgcctgatctcgtcaccgcaagtgtagagtcagatcatggtgtcatgattgctggaagtggcaggccatttttgcgcggacaattggcttatatttccaatcattctgtcggtactatgatcaaaaaaagtttgcatgatcgttttggttattactcccgccgattccctatcacggcagatcagtattttatcaagcgtgtttgtggcgctagcgaaacggtgatttacaaagcagattttgtagcaggctattatccagctacaggcgtgtcaggagcagatgtccctgggacgatggttgaatttttccgcgtgcaattggaaaccgaacctaattcagtgctccagctagtacttttcattttgcgtttgatacgccatacccccaagctcatccggtatgcacactacaaaaaattgcgcgatctaccccagcatgaatagcaacgtattgtttatcactggctttcatcctggaggtatgggttttattggtgcaggtgaggcaatcagtcagcaacatatagagcgactgataaagcaaggaaggaaagtgcatgtgctggcacttgcccctaattatcaagtcgccagtcctgaggttgttgcaagctgtgcttcctacaccacgcttacgcatacgcgatggatgacgtttgcagctttatggcgctcacgccagcagggaagtctgctctgcccctggttatttacgcgtgtatcaccgcaagctgaacgttttatccgtcagttgttggaccaacacgccattactgagatctatcttgattttccatcttgtcttggcttcgcgccaacatacaatcaattacccattcattacattgttcatgatgtgttgtcgcaaaaagttgagcgacgtcctttattaaaatggctgaaaaatcaagtgttgcgcacggaatcgtccctgctgcgtcatgtcacccagtgtttcacactttccctgaaggacaagctgagatgcgaggaaatagggtatagcggccagatagaggtgcaggtgccgcacattctcaaggtaggggttgttaatcaaggagtgccaattgcagggatcctcaagcaatttcctggcaagaaaaacctggttttttttggcaacatgcagcgggctgaaaatcattactccatcttaagatttttgttgtgcagttatcctggcatctggttggagcatcgcgatgttcagtgctggatattaggtttggcaccaagaacgctattgcgttggatatcgaaagtgttgcctggtgttagagtcactggcgctgttgatgacccaactgaggcgtttaaggcggcaactttatgtattgcacctgtatattacggtgctggtgtgaaaatcaaagttttacaaatgctggaatcgggagccacagttatatcgacgccagtcggagctgagggtattcacggcagtgaaaaactcattacggtggaaagtgctcgtctatcctccactatcaagcaacgtttggcagttgaatcatgaatcagcatgaactccccagcgttgcagtgttgttggccagtttcaacggtagggcttggatagcggagcagcttgccagtattcttgctcaacagggtgtcaagcttcatgtgtttattgcggacgacttatccactgatggcacttgggagtggttgaatgtagaggctgcttgtcatcaaaacgtgactttgctgccacataatcagcgtgcaggttctgcgggcaggaatttttatcgtttgatccacgaagttgatctggatggtttcgatttcgttgcatttgcagatcaagatgatgtgtgggatagctataagttgagcaggcatgcacgcttgatgaagctacatcaggctgatggtgtgtcttccaatgttgaggcattttggcctgacggcagagtgatgctgatcgttaaatctcaagctcagcggcagtttgattatctcttcgaatctgctgggccaggttgtactttcttgatgactactcgcctcgcacatcaagtgcgcaatgtgctccaagatgagctatctccagcgcgggatgttactttgcatgattggctaacttatgcaattgcacgttccttgggatatacctgggtgatagatgctaacccttctctgaaatatcggcagcatggcaataatgtgattggggccaatgtcagtcttaaagcgaaatggacgagattgaaacaaatccgcgatggctggtatcgccagcaagtcattaaggtgacacgcatcgcttatgctttttctcagcgcgaagatttgcagcgcttattggttttgctggagaagccttcacttggaaaccgcctgcagttattgccatatgcctggcatggaaggcgatcagtgaaggatcgtttattcctgatgtttagtattgtgtttaagtggttttgaacgatgagtcagcaacatattttggttaccggagctaatggctttgtgggtcgatcactatgcaatcaattatgccaatcagcctttcaagtcacccaggttggacgtgctctaaatagcgctgatgggggagcatatagccaggttgtgtcgatagatggaacaacggattggtcgaccatcttggatgaggttgaggtagtgatacatcttgctgccagagttcatgtgatgcaggaaaacttagttgatccaatcgtggcttactggcaaaccaatgtcgagggcaccttgaatttggccaggcaagcgctaaatgctggggttaaacgctttatttttgtaagttccatcaaggttaatggcgagcaaagtttcccaggcaaaccatttactgcagaagatatgcctatgccagaagatgcctatggcaaatccaagtgggaggcggagcagggcttgcttgcattggcaaaggattcaaatatggttgtggtcattattcgcccacctctggtttatggtcccggtgtaaaaggtaatttttccaccatgatcaaactgctgcagacaggcttgccattgcctttcggggcgattgccaatcaacggtctttggttgctatcgataatttgatccacttaattatggtgtgtattaatcatccggccgccgccaatcaggttttcttagtcagtgatggtgaggatttgtctactaccgctttattgcgtcgcttggctctagcggctggcgtatcatctagattgattccctttcctgcagcatgggtcaacttcgtctttactgttctgggtaagaaaatgatggcagggagaattttagggtctttgcaggtggatatcagcaagacacgcgaggtattaggctggcagcctcctgtgacagttgatcaagggctgcgaaattgttttccaactaaggctgagccgtgattcgtttttttgacattgtattttccttgcttggcctggtattcggtttgccattattgataataatttatctggtcggcttgctcgatacaggctctcccttattccgccaagtgagggtagggcggcatcgccagccatttacgctggtgaaattccgcaccatgaaagtcaacacagcatcagttgccagtcatctggcttctgccagctctattacttggttaggtagttttttacgcagtacaaagttagatgaattgccgcagctttggaatgtgctcaagggcgagatgagcttggtggggccgcggccgaatttgtttaatcaggatgagttgattgcagcgcgtgatgcacggggtgtttatgcagttcgaccaggcatcaccggactggctcaggtgaatgacattgatatgtctatgccaaagttgcttgcagagacagatgcttctatgttgcagcaattaaatttaaagctttatttcaagctgttaattcagactgtattgggcaaggggcgtggtgacagggtcgtgcggtgatctaccgccatgccagttaggcgagtgctattttcgttctgccaacgcagcactatagtttttcagtaaaatacatttttttcattttaggccgtgcgcgtgcatacccccccccatttatttcgttggcctaatttcatcagtttgaaaaacccgcgctcaatcagtgcctgggtgcatgacatcattgccgccatgcttgcgtggtgggtagcatttcttttccgcttcaattttgatatccctgccccatttgccgagagcatgttgcaaagtgcagcttgggttattcccctgcaagcaacatttttcctgctatgcggcctttaccgcggtgtatggcgttttgccagtctgccggatttacagcggctgattcgagcgattggggtggccgcagtagttgtggtagcaattttgtttatgttccagccacatggggttgtgccgcgctcggtgttgatcatgaatcccatgctgctgcttttgttgatgggtggcagccgcattgcctaccgcgcctggaaagagcatcgactgtatggcgcggcccaatcctcaggtaagccagtgttggtgcttggcgccggggatgccgcgattgccttgctcaaggatttatccaagagtcatgagtggcgcatagtgggcttgcttgatgataagcaatcaatgttcggccgtgagttgcttggtgtaaaagtgctaggcaaactcagcgattttcctgagatcgccaaggcaatgtctgttcagcatgtgattgtggccattccttcggcgcgcaacaacgcaggcgccagattattgatatggccagtcagcacaaactcaaggtacttaccgtgccatcactggaagatttgatgagtgggcgtgtcagcatggcgcagctacgtccggttgaggttgaagatttgcttgggcgtgagcctgtggtgttggacgatgatggtttgcaccagttgatcgatagtcaggtggttatggtcactggcgcgggcggctcgattggttcagaactttgccgacagttactcaagtttcagccttcaatgctggtgtgtttcgaccattcggagttttctctttatagcctagagcaagaactgaccgctttaaagctggatgtgcggattgaatatctggtaggggacgtcaagaatgcacgacgcgtgcagcacgtgcttgctagttatcagccagcacagtatttcatgctgcagcctataaacatgtgcctatgatggaaaaccgtaacgttgcagagtcattatccaataatgtgctgggtactttcacagtagccagtgcatgtaaggcggcgggcgttaataagtttgtgctggtatccacagataaagcggttaacccaaccaatgtcatgggggctagcaaacgtctggctgaaatggtgtgtcaaggtttgcaggcggaaacaggaacccgctttgtggtagtgcgtttcggcaatgtgctgggcagcagtggtagtgtgatccctaagtttaaagagcaaattgcgcttggtgggccagtcaccgttactcatcccgagatcacgcgttatttcatgtctatacctgaggcgtgccagttggtcatgcaagccggattgatgggtaagggcggagaaatattcgtgctagatatgggtgaccccatcaagattgtggacttggcgcgtgctatgattaggttgtcagggttgggggatgatgaggtcgacattgttttttccggcctgcgccctggcgagaagctgtacgaggaacttttggcagacgacgaactcactttaccgacgccgcacgataaattgcgtatcgccgtggctagaagtgcagatgaggcctgggttgtggctttgctcaagtgggtagacaagtcatccagcatggatgaggcagtcgtgaagcaagagctcaagatgtgggtggaggagtatgcaggtgatatacatgctagtctttcttctgcgttgactcccgggtcatcgacaatacattaaaagaaagacgattgagatgacaaaaaaaattaccaaggcagtcttccccgtggcaggtcttggcacgcgtttcttgccggccaccaaagccagccccaaagagatgctgcctatcgttgataaacctctgattcagtatgccgcggaagaagcagttgctgctggtgcaactgaactgatctttattattggtcgcaataagcgctccattcctgatcattttgacaagtcttttgaacttgaagcttccctagaagccagcaagaaaaccaagatgcttgaggaaattcagaacattctacccaagcacgtttcctgcatttatatccgtcaagctgaagctttgggcttgggccacgcggtgttgctggctaaatctgtcgtgggtaatgaaccgttctctgtcattttggcagatgacttgattgatgctgaaaagcctgcgatgcaacaaatgactgagttgtttgaaaagcaaggagcttcaattcttggtgttgaagatgttgagccaagcgagacagcaagctacggtattgttgatgcagtggaattgacaggcccagatgtattgcagctgaacggcattgttgaaaagccacagcctgaagatgcaccttctaacctggcggtggttggacgttatattttgactcctgaaatcttcacctgccttgagaatgtcaagccaggtaagggtggggaaattcaattgaccgatggtattgctgcgctgatggagcaacaaaagattctggcttatcgcttcaagggtaagcgttacgactgcggcagcaagttgggctatgtcaaagccaatgtcgagttttcgcttaagcatgaagaaattggtgaggagttctcgcagtatctgcgtgaattgaccaagtaa

SEQ ID NO: 180 - DNA, 26076 bp, Methylobacillus glycogenes
ttacttggtcaattcacgcagatactgcgagaactcctcaccaatttcttcatgcttaagcgaaaactcgacattggctttgacatagcccaacttgctgccgcagtcgtaacgcttacccttgaagcgataagccagaatcttttgttgctccatcagcgcagcaataccatcggtcaattgaatttccccacccttacctggcttgacattctcaaggcaggtgaagatttcaggagtcaaaatataacgtccaaccaccgccaggttagaaggtgcatcttcaggctgtggcttttcaacaatgccgttcagctgcaatacatctgggcctgtcaattccactgcatcaacaataccgtagcttgctgtctcgcttggctcaacatcttcaacaccaagaattgaagctccttgcttttcaaacaactcagtcatttgttgcatcgcaggcttttcagcatcaatcaagtcatctgccaaaatgacagagaacggttcattacccacgacagatttagccagcaacaccgcgtggcccaagcccaaagcttcagcttgacggatataaatgcaggaaacgtgcttgggtagaatgttctgaatttcctcaagcatcttggttttcttgctggcttctagggaagcttcaagttcaaaagacttgtcaaaatgatcaggaatggagcgcttattgcgaccaataataaagatcagttcagttgcaccagcagcaactgcttcttccgcggcatactgaatcagaggtttatcaacgataggcagcatctctttggggctggctttggtggccggcaagaaacgcgtgccaagacctgccacggggaagactgccttggtaattttttttgtcatctcaatcgtctttcttttaatgtattgtcgatgacccgggagtcaacgcagaagaaagactagcatgtatatcacctgcatactcctccacccacatcttgagctcttgcttcacgactgcctcatccatgctggatgacttgtctacccacttgagcaaagccacaacccaggcctcatctgcacttctagccacggcgatacgcaatttatcgtgcggcgtcggtaaagtgagttcgtcgtctgccaaaagttcctcgtacagcttctcgccagggcgcaggccggaaaaaacaatgtcgacctcatcatcccccaaccctgacaacctaatcatagcacgcgccaagtccacaatcttgatggggtcacccatatctagcacgaatatttctccgcccttacccatcaatccggcttgcatgaccaactggcacgcctcaggtatagacatgaaataacgcgtgatctcgggatgagtaacggtgactggcccaccaagcgcaatttgctctttaaacttagggatcacactaccactgctgcccagcacattgccgaaacgcactaccacaaagcgggttcctgtttccgcctgcaaaccttgacacaccatttcagccagacgtttgctagcccccatgacattggttgggttaaccgctttatctgtggataccagcacaaacttattaacgcccgccgccttacatgcactggctactgtgaaagtacccagcacattattggataatgactctgcaacgttacggttttccatcataggcacatgtttataggctgcagcatgaaatactgtgctggctgataactagcaagcacgtgctgcacgcgtcgtgcattcttgacgtcccctaccagatattcaatccgcacatccagctttaaagcggtcagttcttgctctaggctataaagagaaaactccgaatggtcgaaacacaccagcattgaaggctgaaacttgagtaactgtcggcaaagttctgaaccaatcgagccgcccgcgccagtgaccataaccacctgactatcgatcaactggtgcaaaccatcatcgtccaacaccacaggctcacgcccaagcaaatcttcaacctcaaccggacgtagctgcgccatgctgacacgcccactcatcaaatcttccagtgatggcacggtaagtaccttgagtttgtgctgactggccatatcaataatctggcgcctgcgttgttgcgcgccgaaggaatggccacaatcacatgctgaacagacattgccttggcgatctcaggaaaatcgctgagtttgcctagcacttttacaccaagcaactcacggccgaacattgattgcttatcatcaagcaagcccactatgcgccactcatgactcttggataaatccttgagcaaggcaatcgcggcatccccggcgccaagcaccaacactggcttacctgaggattgggccgcgccatacagtcgatgctctttccaggcgcggtaggcaatgcggctgccacccatcaacaaaagcagcagcatgggattcatgatcaacaccgagcgcggcacaaccccatgtggctggaacataaacaaaattgctaccacaactactgcggccaccccaatcgctcgaatcagccgctgtaaatccggcagactggcaaaacgccatacaccgcggtaaaggccgcatagcaggaaaaatgttgcttgcaggggaataacccaagctgcactttgcaacatgctctcggcaaatggggcagggatatcaaaattgaagcggaaaagaaatgctacccaccacgcaagcatggcggcaatgatgtcatgcacccaggcactgattgagcgcgggtttttcaaactgatgaaattaggccaacgaaataaatgggggggggtatgcacgcgcacggcctaaaatgaaaaaaatgtattttactgaaaaactatagtgctgcgttggcagaacgaaaatagcactcgcctaactggcatggcggtagatcaccgcacgaccctgtcaccacgccccttgcccaatacagtctgaattaacagcttgaaataaagctttaaatttaattgctgcaacatagaagcatctgtctctgcaagcaactttggcatagacatatcaatgtcattcacctgagccagtccggtgatgcctggtcgaactgcataaacaccccgtgcatcacgcgctgcaatcaactcatcctgattaaacaaattcggccgcggccccaccaagctcatctcgcccttgagcacattccaaagctgcggcaattcatctaactttgtactgcgtaaaaaactacctaaccaagtaatagagctggcagaagccagatgactggcaactgatgctgtgttgactttcatggtgcggaatttcaccagcgtaaatggctggcgatgccgccctaccctcacttggcggaataagggagagcctgtatcgagcaagccgaccagataaattattatcaataatggcaaaccgaataccaggccaagcaaggaaaatacaatgtcaaaaaaacgaatcacggctcagccttagttggaaaacaatttcgcagcccttgatcaactgtcacaggaggctgccagcctaatacctcgcgtgtcttgctgatatccacctgcaaagaccctaaaattctccctgccatcattttcttacccagaacagtaaagacgaagttgacccatgctgcaggaaagggaatcaatctagatgatacgccagccgctagagccaagcgacgcaataaagcggtagtagacaaatcctcaccatcactgactaagaaaacctgattggcggcggccggatgattaatacacaccataattaagtggatcaaattatcgatagcaaccaaagaccgttgattggcaatcgccccgaaaggcaatggcaagcctgtctgcagcagtttgatcatggtggaaaaattaccttttacaccgggaccataaaccagaggtgggcgaataatgaccacaaccatatttgaatcctttgccaatgcaagcaagccctgctccgcctcccacttggatttgccataggcatcttctggcataggcatatcttctgcagtaaatggtttgcctgggaaactttgctcgccattaaccttgatggaacttacaaaaataaagcgtttaaccccagcatttagcgcttgcctggccaaattcaaggtgccctcgacattggtttgccagtaagccacgattggatcaactaagttttcctgcatcacatgaactctggcagcaagatgtatcactacctcaacctcatccaagatggtcgaccaatccgttgttccatctatcgacacaacctggctatatgctcccccatcagcgctatttagagcacgtccaacctgggtgacttgaaaggctgattggcataattgattgcatagtgatcgacccacaaagccattagctccggtaaccaaaatatgttgctgactcatcgttcaaaaccacttaaacacaatactaaacatcaggaataaacgatccttcactgatcgccttccatgccaggcatatggcaataactgcaggcggtttccaagtgaaggcttctccagcaaaaccaataagcgctgcaaatcttcgcgctgagaaaaagcataagcgatgcgtgtcaccttaatgacttgctggcgataccagccatcgcggatttgtttcaatctcgtccatttcgctttaagactgacattggccccaatcacattattgccatgctgccgatatttcagagaagggttagcatctatcacccaggtatatcccaaggaacgtgcaattgcataagttagccaatcatgcaaagtaacatcccgcgctggagatagctcatcttggagcacattgcgcacttgatgtgcgaggcgagtagtcatcaagaaagtacaacctggcccagcagattcgaagagataatcaaactgccgctgagcttgagatttaacgatcagcatcactctgccgtcaggccaaaatgcctcaacattggaagacacaccatcagcctgatgtagcttcatcaagcgtgcatgcctgctcaacttatagctatcccacacatcatcttgatctgcaaatgcaacgaaatcgaaaccatccagatcaacttcgtggatcaaacgataaaaattcctgcccgcagaacctgcacgctgattatgtggcagcaaagtcacgttttgatgacaagcagcctctacattcaaccactcccaagtgccatcagtggataagtcgtccgcaataaacacatgaagcttgacaccctgttgagcaagaatactggcaagctgctccgctatccaagccctaccgttgaaactggccaacaacactgcaacgctggggagttcatgctgattcatgattcaactgccaaacgttgcttgatagtggaggatagacgagcactttccaccgtaatgagtttttcactgccgtgaataccctcagctccgactggcgtcgatataactgtggctcccgattccagcatttgtaaaactttgattttcacaccagcaccgtaatatacaggtgcaatacataaagttgccgccttaaacgcctcagttgggtcatcaacagcgccagtgactctaacaccaggcaacactttcgatatccaacgcaatagcgttcttggtgccaaacctaatatccagcactgaacatcgcgatgctccaaccagatgccaggataactgcacaacaaaaatcttaagatggagtaatgattttcagcccgctgcatgttgccaaaaaaaaccaggtttttcttgccaggaaattgcttgaggatccctgcaattggcactccttgattaacaacccctaccttgagaatgtgcggcacctgcacctctatctggccgctataccctatttcctcgcatctcagcttgtccttcagggaaagtgtgaaacactgggtgacatgacgcagcagggacgattccgtgcgcaacacttgatttttcagccattttaataaaggacgtcgctcaactttttgcgacaacacatcatgaacaatgtaatgaatgggtaattgattgtatgttggcgcgaagccaagacaagatggaaaatcaagatagatctcagtaatggcgtgttggtccaacaactgacggataaaacgttcagcttgcggtgatacacgcgtaaataaccaggggcagagcagacttccctgctggcgtgagcgccataaagctgcaaacgtcatccatcgcgtatgcgtaagcgtggtgtaggaagcacagcttgcaacaacctcaggactggcgacttgataattaggggcaagtgccagcacatgcactttccttccttgctttatcagtcgctctatatgttgctgactgattgcctcacctgcaccaataaaacccatacctccaggatgaaagccagtgataaacaatacgttgctattcatgctggggtagatcgcgcaattttttgtagtgtgcataccggatgagcttgggggtatggcgtatcaaacgcaaaatgaaaagtactagctggagcactgaattaggttcggtttccaattgcacgcggaaaaattcaaccatcgtcccagggacatctgctcctgacacgcctgtagctggataatagcctgctacaaaatctgctttgtaaatcaccgtttcgctagcgccacaaacacgcttgataaaatactgatctgccgtgatagggaatcggcgggagtaataaccaaaacgatcatgcaaactttttttgatcatagtaccgacagaatgattggaaatataagccaattgtccgcgcaaaaatggcctgccacttccagcaatcatgacaccatgatctgactctacacttgcggtgacgagatcaggcagacctatgccagccgcacgcttaaacgcctcgacagcatgtggatacaaaatatcatcggcacccaagaccaaataataatcgcctgagcttagcgaaatcgcacgatttaatgcatcgtatataccaaaatcctgttgcgctgacagcaaaagattaatgcctacaacgctttttagataagatatagtttcgtcacttgaaccgccatctgcaacgacccactcgaaatccatatcagtttgactaagcaggctttgcactaaatctggtaaatttttagcggcattatatgttgccgtaatcacactaagtttttgcattttatttgatcttagctgtagcggtaaatcctctgatccatgtgtaataagaagccaattttggcctaataccacatttttctggcaacaatggcaacggaatggcaaaccgatgcaacatcccaatttttttctgcaaagtcgcaagatactcgtcatagaggtaacgagaacttttagctatctggtacccttcataaagtctgacaagattaaacttgattatgcggaatgcatgaaagtggtaaaaaaccggcttgaatttcccactttggtgctgaagttgatagtctacattccaaggtgccaacgtttgttcaacgcacttcaatatgtggacatcatcggcaaaaattgtaggccataaatctaaatatttctgatcaccaaactttccatcctccatccttgcaaaacaccactccacgcagcgatcttgccaccaatgcataactttacgggatgcttcacttcgatcaaataccatgaattgcacacaaaaccgtccactcgtttccagatgctgaatgtaatcgggtgcatatgcatgctcagtaatcatcacatgcttgccgctttgttcaaactcatgaaaaagtatcgcaggatcgttgaaaaaaaataaatctgcatcaagataagtgactcgtgccacctctgggtgttgagcaaacacccattcggcagtgaatggggttatggtccagcaatactccccctttgttctgcctggtttaacggccaataatgcctcgctttcaaaatcggccaagcgcataagcgaaacatgaggcaactgcaatttttccagttgctcatgcaccactttatccatacagactatccataaatgaaaatccctggcatggcgggccagcgactcatgcaggcacaaaccttgaggcagaaacttgctatcaaacagtgtgacaaaatgctccatgtttacagtgcaaacctattgactgcagcaatgacggtctgaacatcttgttcagacatttgaggatgacatggcagcgaaaggcattgctgtgcatgggcctcactaaattgcagcccagccggatctctcaatatatcgctgcacttttcctgatgatgaataggcacaggataatgaatcaatgcctgaacgccatttgcctgcaagtgagcctgcaatgcttcacggtgctccgttagcacaacaaacaaatgatagacatgggctaatggctctgttggagtttgcatgaggcgcacgtatggattattcaactgctgcctgtattgagcggcaattgattgcctatgacttgtatattgttccagccactctagccttaccgtgagcaaggccgcctgaatttcgtcaagacgactattcaagccaaactctggatgatggtaacgcacactttggccataatttcttaacactgcagccttgtctgccagcgcagattgagatgttaccaaagcccctccatcgccaatggcgcccaggtttttggtcggataaaagctgtaagcaccaaagcgaccaaaactccccgccactttaccttccgcttgcgccaaatgtgcttgagcacaatcttccaacaaagccacttgatgctgatcgcacaagttcagccaggattgcatatccctgatttgcccgtatagatggactagcaagaccgctttcgttcgcgagttgatgcatcgcttgacactttcatgactcaataagccagtgtcaggatcaatatcggccaagaccggcgtagcacctgcacgtatgatcgccagcacagaggcaaaagccgtcatcgcagtggtaatcacctcatcaccgggcccaatgtccagcgcgcgcaatcctatctcaatcgcatccatgccattgccaacacccactgtatgagaagtgccgcaacgctgagaccacaatgactcaaacttgcgcccctcctcacctaatacataccaaccggagcgcagcacacgctcgacggcttgcagctgcgctgcaatcaaagcttctggttcagccttgaagtcattcattaaaatcatacgttgtcccaatatttatcatgatgctggcgatagtatgccaggcttgcagcaagcccttgttgcaagcccacacgggggctccaacctaaaacctgcttgattttattgaaatcactatagtagtcaccgatatcaatggcttttctctcaggtgggaatggcacaatctcatagctggaaccaggctgaaattgtgtcattaattcagctacttgctgtaaatttacaacctcatcactgccgagattaaatatttgcccatctgcttctgtattggcggcagccagtaacagagcatccaccacatcatcaacgtaattgaaatccctcaattgcaagccatctccaaataccgcaattggcttgccttcaatcactctacgcaaccaaatcccaagaaaagtctgacgggcatccttgacgcgcatgccaggaccatatgtatttgtcagacgtagcgcacaggctttgataccgtaaacattgttatagagaatgtgataccactcccctgccaatttattgatgccattcacatccactggctgaatcgggtgtgactcatctacaggtaaatactcaggcttgccataaagctgtctggtgctagcgaagactattctgacatcgggattatgctgtcggcatgcttccagaatggataattgtgctgcggcattgatatccagatccgtcctggggtcggtcatggaatccaaatggctagtttgtccagcaaggttaaaaaggtaatccttgcctttgataagataagccatggcatgactatcacgtacatcgctgatgttgatattgaccagcgattcatagccactaaggttaaaggcattgccaccataaagaggtaacaggctatctacaacggtcaccttggctttgtgcgcaattaatcttttgaccaagtttgaaccaataaaacccaagccaccagtaacaagaatattcttacctgagtacagttcatcattcatacaattaccttaacaatttcacaacaagagaatcaacccgtacattagaagaaataagacacagtaactcaaagatgaacaattgcttgttagaaaatcaacttacactcttgcgcttgaaaaaaagccctttgtaatagcctatgtccgtcaggtctgcacaaggaaactccatgatgacctcataccctcctgcactcatagtatttataaatttgtcccaagaaatgaaccaggcagggtaacttgccggataaatcgatgcaggcactgtctggacagttaagcggtcaacaacgtcataaaaagccgtgcgatcgaaaagaataaactcagaatctagcctcaataattcttctaacagctggtatggatgctccaaatattgcaggacgctggaaagaaaaataacattgggttttccatccaaaataaactctgtgaggctattgtaaaatttaagatcagttgtggttaggtgctcgcgaccccaggcaacaaaatgtggctgctcaacaactccccaacgcaaatccttaactatagacaatattgcagcatgctgagaataaaaacttgccagagagcctccaaaatccaggacactcaacttgccaccagaactaacagctgcgtatagcaatccagacaaagcggaatatctatactcaacatgatggaaacatactgaatctcgttcaaaaaccgcttcaccacgcttgactttgagagctgactcttgaatgatggtgagaatattttccgcatcatagccaccactattttgtttagcatgcgcccaagaagaataatttccggcgaacgaagaggcaaagttacgccgcctatacttctgcagaatatgcagaaaaagtggggggcataataattttaggatcttgataaaactcataaaaattttttaaatacggattttgccttcagcatcattttgcgaacaactgatggtttgctttcaagaaaaaattgctcaaatttcttaaatgccggctcagactcgcgcaatggaatatcagtcaatagtaatcggtcagctctcaactccgcagagtatgtttcgctttctccacaatgcacaccggatccatcatgtccaatattactaagcaaagctttaccaggataaagcgtcaacttattaagcaagaaagcactagcatgccaacgtattgcccaagaattattggttcctgcaatctggtcgcgcaacatatttgaaaatggataactaccgttataatcaaacttattcagcaagttaagctgcttcagttgcgcaaacaacttacttccatctggttcaaaccaatcccatctatccctccatgtagcccagccccagcaatctgcaccacgcaaaaagaaagtatcgggcaatcctgcgatgggataaacataggcatgaatacttgcaacttcatgaaaatcagcatactgactcaagctatcattcatgtattgaagaaaatatggactggtgaccatgtcgtcttcaagaactattatgcgaccatactctgcaagtacatttgttacaccatcaataatcgaagcagctagcccaaaattcgtttgacgttctatgattcttactgacttgaagccttcaacagtgtgagtaaacgctctgacagcatccaccatgctttgctgtgtaatattttttgcagcatcagaaaaaatcagcaagtccgtttcagcagacaaggtattattcttcagtgcttcaatcgtccttttagtatggtcagggcggttataagtaaacagggcaacaggtgctagattggacatggttacttacagtttcaaaagatcttgataaaactcagtgttgaatgtacgcgctatgactttgtaatgattttgaatcatgaaactgcgtatgcgttcgccagcgacatcatcaagtgcttctgccagaactatacgaggcctgtactttgaccagtcgttagaggcaagcacttggtaatcaaagccttcaacatctatactcatgaaatcaatttcagtatccggcagcagcacttcatccaaaattttagtcaagggtcttactggcaccttgcgggtaccgacgcgtttataagcagtgttttgtatacgctgattggccaattcctcactgaaggtattgagagcaggctcatcgaacatatgataagtcagctcagactcatgatcagatacccccatttccaaggcaatatctgctgggcgccgtgttttaaacaaagcaatagcctcgtgtgagggatctatacaaactcccctccaaccacgtttataaaataaataagtattggagaaccttactgggtgatgagcacctatatcaatataatacccagtagaggttcggtcaaaaattctactcagaattaaatcttccccctcttgcgcataagagaatttatataagcctctatcccggtaaaatgaaaaaatctcttgcgaataattaaatatttttaaagcaatacttgagatagacataaatttatactttattgattaatgccaaatcaactgtatgatcgacttgagacatgatataaggatcatgactgacaaatataatgatcttattttcatactcattcataagattccgtatcacaatttcttgtgtagccttatctaaagctgttgtactttcatcaagtatcagcacattaggtttgcgcactaatgctctggcaatagctatacgctgacgctgcccacctgaaagattttttccttgatattgcaaacgtgtttcataaccttgcgcaagactttccacatctttagaaatacaagctaattcgcaagcccattttacgtcctctagagtaaaagtctcgcccatacaaatattgttgtagaccgtatcatcaaaaatcgcaggttcttgattaataagtacaatagaatgcctgatatgtgctccagggatattttctgttgaaataccatctattgaaatactgcctgaagcaggaggataaaacttcagcaaaacatccagcaaagtagactttcctaaaccagatttccccactaaagcataagagttgttcttttcaaactcgtagtaaacagaattgagaaccgctggccttacgccttgaacatcacggtatgaaaacgacaaattatcaatcttgattgtatctatcttgtgtaaatagttgtctgaattagcgctctcggcactttcatcggaaactaattccgtcacatcttttcccgatttcgcatctgcaacaatgcgaacagctagagtgatactctgaccaacaactgggaaaaatcgcatgagataagctatcaatgacacaatgtaagccatccctaagttttcaacagaaacccagccactcaatatcaaagccaaagatccgagtaatagaaatattattggtactaacttcgtagccagatttattgcatcaaggtaaaaaagaatatttgcatacgtaaaaatctttcgcctatacaaaccggcaacatacttctcggaagaaagtgatcttactgctttgatattgttcatcgcatccatgaaaatggaatttgctttccttgaaccttctatttgcctcacgcccatcttatgagatatttttaaaatccaaatgaagaatacggcagacacaagcattaaaatgaaaatcatttcggcggcatatagtgaataaattgcaatagaaataaaatacattacccccagtaaaaatgttgcaacaaactgagtcaatgcaacaaccagagtactcgccctgaaggattcatctccagcaagccccataaaaaaacctatacttttttcagatattttatcaattgacatcgaagtaatgattttttcaaaagccctagaaccgagctgagccatcacacgtcttccaaggtagtgcgtcaggctttgactaaatagttgcgtgactactctcaaagtgaacaataagaagaaaacttgcaaaaggctggcagcatcaactgtaaaccccaatataatcagagcttttgaaatcaaaccatgcttatctactgtttctcctgaaacaagttcaaataaaggcaataggcttgccattgccaacaattcaatacctatagaaagtatagaaattaaaacactcaaatacaacaatgggttgttattgaaagcaaattttaataacttaaaaatatattttgcttgtggcaatttattcaacaactttcattttaatggtaagtgttactaaatataaattgtattaaatatcagataattaacttatatcgaatgttgttttaccgtagcttcaatttcataatcggaaacagcatcgaccacatcagatattacaccctcaaaaaggctagattgattattaagaaccagacttaaaaatcttaaacggtctgtgtcgttggactggacattccatacgtcgtagctttttcgcaaattaactgaaaacttgttagccacccttttcaatattctatacgccggcttatccggccaactcagaccaatctccagtggctgattaactctgacagtgcccagtgaaaaactgaccgcgagccagcgataggcattaactacatgtgtattatctgttgatgttgccaaagaaagtactttgataaggttgtcataatactcatgttcagactctcccgttagatgtatatccgccggataggaaggtaagtatttatcataggtaatcacaggtatgccatgtagcaatgcttctacaccagtggcagaccaccctgttaccagcgcatgtacatcatcgagaaaatcgtataaagaaatattctgatctggtgagtttaatttaacattctcagggagatcctgaagtattttttcccaaatcaatgcttgctcagactgattggaatcgcgtttattaggatagtctcgcggatgtactctaattacaagatagtcatcaggcctagacttcataaaattaattgtacacttaatccattcaaactgatctgagaaaaccggacttttaactttacgctcaggaaaacctttgataacaaaagccgcatacgcttcatcaaaactacttaatgaggcgagtagaattttagcattctgtggaatattgaatttttcacggattgaaaaatttcctgtttttggcgctgaaaaaacagcaaaagatttacctttgaataattcgtgaatatgtgcagagactctatcaatatcttcaagcgttactaaatttttaacagcttgccaatgctgcaatgcagggtttactaatttaaatttactccactcccacacccttaaagcactatatcgttcagcattgctagagctaccttctataaaatatgcctgtctcccctgttttactgcatattctgcacacacaccattaacaccatactgtggactataaaagaaaattttttctggacactcttgtttgaatatttggataaaaccgattaacgataccagggcattcctaaggtgaatctgtagatcttgccattgttcatctctaaattccaaagacattttcttatacttaagaagtggctcatatgtagccaaacgccctactggtatatcttcataatgaaattcgaggaaattatcttccgtgacacttttcaataggttatcaatcagagcattagttttctgatcaatataatcatgcaatttaagatgcttgcaatcaaaagacttggttattttattggcgttattaatacataactcacaaattgcacttttctttttaaaatcctcattcaatgcaagattgaaagcactcataccagtgcaataatgagtaaagcttttatcacaggtcacatatactaactcatggccggcattactcagctgtgatgccaaccggctttcaggaagcgcatgtaaccaaatagctgcatgcaaagaataaaacatggctttcatacttttacttttctcaacaacctgtgataggtcaaacgtaaattagctggacgctctacccattttccaatataaattgacatagttaagatgattattagcgataatgatgacatcaactctctagtcaggctaccgtacacatcaaagttatatgagaagatggcgtacgatagtaacaacatagggaaatggacaatatataaagtgtacgaagtattggccaaaatattcattgccttaatttctggcactttgcattttattgctgccaaaaataaagaatatacaaatataacttgcactggcaaagaaacgaacttctgtccaatcactgccatagcaaacaccacaatagccattacaacaaccaaagtcatgaactttatgaaatttcgacgatataagaaaattacaccaccgctcaaccaccataagccataataaatatcggtttttgtattaaaaaacaagaatacagataatacgagaaaaccagtattagcaataaaattgagcaaatttttttgtttataatgaataaaaattattacaactaaacaagcataaaaatatagcttagcctcaatgcataaactccataatggcccattcatttgcaacaagccattattcatcaataaagaattgacaatgtctcgcgtaccaatgctcaagtagtctcttgcctgatagatatctcctggtgcctttaaagtacccactgatcccggtagttcaaagatcacaatcacactataggcaactaaagatattattatgcttacaatgagaggaggatatatgcgcaataatctgctagatgcgtaatcaagtactgaaagacgccctccattacgttgagtattgctatgcaaactattcgaaattacatagccacttaatacaaaaaataagaggaccgcggtttcactcaaaaaatgattcaactcatatttccaggacaccaatccaatggttggtaaccaataaatttgaaaggtgtggctgagaaaaaccgttagtgctgcaatcgcccttagataatcaaggcttttaatcataataactaagcatacaattacaacaattaatcatttaagcttatgctcacgtaaccactccactacccttggagcaatcaaatcacgtttttttgtgacaacatcaagtatgttacagctctcatcacgagatatagatgaattttcaataacaatattgcactttctcaacaattcatttttaaaacctatttgtctgacatcaacaattttttcttttattcccaactcataaaacaattctttaatttgcttgtatgagtacaatcctattactggaattttattagctatggctacaacattggcatgaaatcgcataccaagtatcaaagtacatttgctatattcggaaaataatgtcccttgaaaattcacattagtatcgtaactggccactttgacattttcacgtctacatgcatcaggcaaccgtgatagtatgtcggcatatactttaagatcactataaatatgtggaaaaaaaataaactttattaatttatttttattccacatttcagccaaagtctcggtgaactcggatataaatcctgagtaatcatatccattaattccacctggaaaccttgtttccaacatatctccagccagattgatgccgatggtgatctgagtgttttcatgatcattttccgcaatgtctttttctaacttatccagatttacaaaaaacccaccgtcaggcaatggtaagactttatccaacatgggattattagaaatccgatttctgagcgtgcccattgctccatcattacgaacactgaccaaatattgctttgatgaagttaagatttctaagaaattagtaaactttgcaagactttcatcactacatcccataccatcatcaacacccaatgcattgaaaaagatggggacttttatttttttaaaaacctcaatctcaattgagattgaggtgccggttggagaagaatcaacccatagctcgaaaaaattaccacctcccacgactataagatcgtactgatttgcaatagctacaaaattatcgtcaaaggcaacattttttcggtaaacattgcgtatttcgaattcatcccattgaatctctccaagcagtccttgaaaccaattgcgaaaaccataatggttggcaatgtcaccgacatttccggagaaacttcctatctgcaacactttcattcttaggtcacctgatgcttcagtatccaattactgtcttgcttttcccacaaatgtggagatctaaacctatctacggtttcccaaaactgtgcttcggtgatctctatatattcaaggaattctgcaaagtacttttttggaaactcttgatcatatttatgaactagagcaaccccttcttctcgcgtaattttatcgttgcgaatttcttgcgcagcatcatatgttgccctaccaatgccgaatttgatcaaggtagtaaagtagtggaacatatctattcgatcatcgatactactgtacttggagtaggttccttcagtgcgttccgtatttgcctggaaaccagtatgctcgactgcatagtaatagcactcttgtggatcccatttcaggtaatagcccaaataatgtacctcgataccatcgcgctctagatcttctgcagcaggcggaatatatggcgcgaaatcatttaagctgtattcaccgtctttaataatgtctccaaccttcacaccacctaacaccatgtcagctgggtctgaaatagagaaaaaattcttgtccattgtcggtttatagttttcttctgtcttattgccatattcagcttgattttcaccatacattaccaatttgataccaaactttttagccatcaacggcccgataatgcgttggccaacaatgaatggttggaatgggtgcaataaattcagaaatgccatttttgttaaatagcggtgcaacttgccatttggggtaaaaagaatattgtctaatccacctttatggatccagttttcaaaattcttccaaccaatctcagtgtacttatgcggcgcccacgtcactgttaaaggattcataccatatttatatttaaggatatgtgaggtatatgcactgtctttaccaccactgccgggcacgacaatgtcatatccaccatcgctacggcgatgttgatccaacaatctaaccaaagcgtcctcgcgggcctgccagtctatttgagcatccttggtttctgcatagcggcaagcatcacaaataccatcagcgccaaatcctatggtcgcttttttgtccttgttggtatgcttgaattcaactgtagaactgggtctttggttggaaatcacgcatttcttgcaaaacactacatcttccggcaaaccaaaatatgcattaaccacaacttcctccacacttcttttcaattaactgttttgtacaaagttattaagaacctgtaacccgctgggcccacttttttctgggtgaaattgcataccccagatattgtctttctgcactgatgcaacaaaagtacatccagaatacgtcgcgctgcctgtgatgtatcgatcaggtacattttgagcggcataactgtgcagaaaatagaacttacgctgctcgtctggcagtccatcaaacatgccgccattattttcatgaacggaattgagatcaactttcgcccaggatatatgcggtaacctcactcgtgattgctctacgggtacaattctggagactacgccaggcacaagtccaagaccagtggtaacgccaaactcctcacccctgtcgaaaagcaattgcatgcccaaacaaatccccaagacatgttttccactttttatatattcgagcaagctagcttgtaatccatctttacccaatgcagacatgccttgagcaaacgcaccaacccctggcactattaacgcgtgagaatctttaagtgcctctggcgtatttgagattacaggatgagcacctacgtacttgatcgcattactcacactacgcacattgcctagcccataatcaagaatacatattttcttcatttatttagtaccattgatgaatgtcagacgctgtttgaattcatctatcgtattgattttgtaatgcaatactgacgccagacaaactccacttggctggatttcttttaactcttgcacatgatcaggattaccgcagccaccactaaccatgactggaatgttcactatcgtgttaactgcaccaagcaatggaaggtcaaatcctttttttgtaccatcttggtctatagacgttagcaaaatctcgcctgcaccaagatcttccagctccttgctccaagcaacaacatttttgcccgtaggctccctcccggcttccatataagcttcccagtcattgcctatccgtttggcttgaatagaggcaaccacacattgactgccatagcgcttggcaatctctgtgatgaatttcgggttaagtattgcagctgtattcactgccactttgtctgctccggcactcagagccatctcgacatctgctaaggaacgcagccccccccctacagtgataggaacaaaaacttcttccgaagccttggcgattacagacagcaggttattacggttatacaagctcgctaccgcatctataaacacaatctcatcaatgccttgtgcataatagtttttcgccatctcgattggatcgccaactttccgcaagccctctaggtgtatgcctttaatcacatgttcatttttgacatctagccttgcgatcaacctcacactgcactcctatcgataaagtgcttttgtatgcccttatcccaaaaagcattattcaacagaatctgatgaaactcacctgcactattaccattaccaaagtcagaaactgccacgcgaggaatgtctgcaacttgttgaacagcatgtctaagggaatccacatgtgcagtagtattaagaatcgactctgctgttgctctattgtgttgcctgctaccaacattgatggctggcacgccgaaatgaggagcctctcttactccagcgctagagttacccatgatgaacgctgcatttttttagcagcgttaaaaaatattcaaatctaatggatggataaactctaacgtggctcaagtttttcaatcgcaaatactcattcaaaataatgtctgaaccatgatcattattgggatatacaacaatgaatggtagagagctttctgaaatataatctacgatggctttggcttgtcttggcaaatcatctaactcagaggtaacggggtgatacatcaaaatgccgtaatgttcgaacgagaagccataacgttccctcacatcatcaatgcttggcagcgatgttgaattcataacatcaatatctggggagccaataacaaaaatggattcttcactttctccaagctgaataagtcgattttttgcctgttcgttggaaacaaaatgcccatgggacagcttggtcaccgcatgtctaatcaactcgtcaacagtgccagagacctctccgccctcaatatgtgccactcgaatgttatttaatgcgccaacagcggctccggccaacgcttcaactctatccccatgaatcacaatcagttctggtgaaatttcttttacataatctgataaaccagtaattgttttggccagaatatgatccatgctatcgctttgattttgattgataaagcgaaataggtttttaaatccggctttttctacttcttcacatgtataaccatatttcgacaacatatgcatgccagtaatgaacacatggacgtcaaatcccatgtcattttgtaatgctcgcatgagggatttcagttttccaaaatctgctcttgttccagtaagaaaaacaactcgcctactcatgcctcaatatcctgccgattaactcttttgccactcagtatagtttgcgatgctttacgaccaagtagctgatcatagtcagaagcattaaaatcaccgccacctggcctacgtaaccaaatattatcttcacttaagacatcaccaacattgatatccttaattgcaacgacagatgcaaaagcaaaagctatagttttttcttcttctaaaagtggacctttatgtgcaccttttgctgaaaaaataacttttgaaccagtgattaaatcttgcaatgctgcagggtccattgaacaaacaatgtctggtcccggccgtgacatggagtcagtaaaatgccgctcaagaattgaggctcctagtgcaacagcccctaggcaagcgtaattcccaagggtgtgatctgaaagtcccacaaccgcatcaggatatgcatttttaatgacttggatagcatcaagtcttacaagctcaggaggggtagggtaaatattcgtgcagtgcagaagagcaaaaggaacttttgcttgccttaatatattgacggttggtgcaatgctttcaatgctattcataccggtactaacaataataggtttcccaaatgaagcaatatgccgcacgagaggataattattgcactcgccagatccaattttataagccggtatatcaaattttctcagtcgatttgctgccattctcgagaatggcgtactaataaaaatactgccttgctgctgcacatattgcatgagcttatattcatcatcctctgacaatgagcaacgttgcataatctcatagattgaaacatccgcatttccaggaataacactcttggcttcatcagacatttcatcttcaaccacatgtgtctgatgttttattatctctgccccagcatcaattgcagcttttgccatatcaatcgcaagatctaatgaaccctcgtgattgatgccaatttctgcaataactataggctcatgtccgtccccaattttccgcccagaaatttcaaaagatgccatattttttccttaataatgcttctgtttctaaaaaatcttcttcggtgtcaatatcaacactttcttcagcagacataatataagcaacactaccattggaggggaaaccgcctctagcctcaaattcaaatttcgaaaagatataaatagcaccatttggcgcgtaacataatggcaaatcttgacgacgataattagataatttttcatcaaataatgaaatcaatttatcattatcatctagacgaaatgacttatatggcgacttatccaagacttccacactgaccaaagaagtaaggccattattattcaaagccgtcaaagcatcatcaatatgatgttcatctcttaatggggaggttggctgtaagtaaacgattaaatctccatcctctatattttcaatactaataaaatgcttgacaacatcaacagctgacgcatcatctgttgcgtattcttgcggccttaatattgaactgcagccttgtgcttttgaatactccaatatttctttacaatcagaagatacataaacagcatcgacatttttagcttttttagcagcgttaattgtgtaagctattaatggagaacctgcgatatttttcaggtttttttttggcactcctttagaacctgctctggcaggaatcaaagcaaacactttttttttcaaaattgaacattaaattttaaaaattatcgaggttatataaattatctaaacgctatttttgaggataatatcaattcgatatcagaaataaattaataaactcagatttattttgttaaaaattccgaatatgtcttttccaatccatcatcaagctcaatggaataagtccaccccaaactgttgagcttgcttacatccataagcttacgcatcgtgccatcaggttttgaactatcgaactcaattgctccttggtaaccaaccaccttttttaccaattcggccaattcctgtattgaaatatcgactccaataccgatattgactagtggtggatcaaacacaccagtagcactctcatcacttcccagcagagaattgaatttctcctcaggcagattcagcaagaatatacaggcatctgccatatcctcactgtaaagaaattcgcgcctgggtgttccagtaccccagaccgatacagctgcatgcccagcttgtttagcctcgtggaatttgcgtatcaatgcagggataacgtgactattctgcaagtgatagttatcgccaggcccataaagatttgtcggcattgctgcaagaaatcgagtgccatactgccggttataactccagcacatttcgactccagcaatctttgccagcgcgtatgcacgattggtagcttcaagcgatccggttagaaagtggtgctcatgcatgggctgaggagcatgcttggggtatatgcagctggaccctaaaaacaataggcgctttactccatgcttccaggcactatggatcacactgttctgaattgcgagattgtcacggataaaatctgccgggtaagtgttattggccactatgccacccactttggctgccgccaggaaaacatattcggctgatactgagcaaagaatgcttccgtggcattagcatctgtgaggtcaagctctgcatgggtacgcttgataagattgctatagcccttgccctctagccccctaacgatagcggaacccactaggcctcgatgccctgccacatagatacgtgcgtgtttgtccataggctcaggttactcgttatagtcataggcagcaaaaccatgctgcttaaccagttcgtcacgctctgcgctcttgagatcttcacgcaccatttcagaaaccaactcctggaaactgatgctgggcgaccagccaagtttttgctttgccttgctcgggtcaccaagcaatgtttcaacttcggtaggcctaaaatagcgcgggtcaacctgtacaatgcacctgccttgaccgtcgtatcccatctcttcttggccctgacctttccaggtgatggcaatatccagctcgtgggcggctgcattgacgaaatcgcgcacactgtattgcacacctgtcgcaatgacgaaatcctctgcctgttcctgttgcaacatcagccattgcatttcaacataatccttggcgtgaccccaatcacgcaacgcgtccagatttcccaaataaaggcaatcttgcaagcccagcttgatgcgcgccaaggcacgggtaattttacgggtaacaaaggtctccccacgcaaggggctctcgtgattgaataaaataccattacaggcgtagatgccataagcttcgcggtaattgacagtaatccaatatgcataaagcttcgcaaccgcatacgggctgcgtggataaaatggggtgctttctttctgcggtgtttcctgcaccaaaccataaagctctgaggtcgaggcttggtaaaagcgggttttcttttccagccccaagatgcggatagcttccagaatacgcaaagtcccaagaccatccgcgttagccgtatattcaggactttcaaaactgactgccacgtggctcattgccgcgaggttatagatttcgtcgggctgaacctgctgaatgatacgtataaggttggtggaatctgtcaaatccccataatgaaggatgaaattctggttatcgacgtgagggtcctgatacagatgatcaatgcgatctgtattgaaaagtgatgctcggcgcttaatgccatgtactacatagcctttgccaagtaaaaattcagctagatatgctccgtcttgtccagtgatacctgtaattagagctactttttttaacat

SEQ ID NO: 181 - DNA, 4093 bp, Methylobacillus glycogenes
gtgaataacggatttgtaactaacttcaagcaatccagaaccctgtgtgtcggtgctgtgattgtgctcgctttcgcattgtcgggctgtggcgacaagcatgaatccaaagccagccagtctctggttaaggtcaatggcaaggaaatcaccgtacatcagctgaatcaggagctgggtcgtgccaacattcaggagaatcagcgcgagcaggcaacgcagcagattctgactgcattgatagatcgccagttacttgaagaagctgcgctcaaggccaaggtggatagggatccaaatgtgatgaccacgattgaacgtgcgaaatcacaaatcattgctcaggcatatctgcaatccaagttaggcagtgtcgccaagccaagcaaaacagaaattgagaatttttataacgagaatcctcaattcttcagcaagcgcagaatggtggaaatggatcaattgttgattgatactaaattcgccaatgatgaattgaaaacagcacttggcaaactcaagaccttgcaggaagtagccgcatggatggatgcccataatattcagtacgatcaaggtcaggtttcacgcagtgttgctgaattgccgccacagatttccgagcgcctcaaggccgaggataagggtaagttgttcgtgatcggcatgggccctcgcaccatgttgatcatgatgaacgagatcaaggacagcccagtttcacttgcagaagcaacaccgcaaattgaaaacaatttgctgaataaggcgcgcaaggaagttgctgaaaatgaagtcaagcgcttgaaagccgatgccaagattgagtacatcgataaaaagatggaaacagcgactgaaaccaaggcagccaaaaagaagccaagctctactgaggatgatatcgccagtggtgttagtggcttgaaataagtactccccatccttaatatcaggacgatagtaaaatgaaaaaattaatgacatggtttttcttgctgatgctgagtctgacgccttttgtaacgcatgctgcagaaggtgacattcttctcggcgctggcgatgtgctgaaaatatcggtgttcgagcagcctgatctgtcacttgaggtcagagtgagtgaatcaggttccattacttatcccctgataggtgaagtgcgtgtgggtggtggtacggttgccgccgccgagcaaagaattgccaccatgctggaaaagggtggtttccttaagagtgctcacgtcaacatcatcgttgcgcaattgcagagccttcaagtctctattctgggtcaagtcaatcgcccgggcagataccctatagatagcgctaaaacgctggcggatgtgcttgccttggctggtggtgtatcacctgaaggtggcgatctgatcacgctggtgcataacgtcgatggtaaagcggtcagggatcagattgaccttgctgacatgatgcgtactggcgatctcagcaagaacatccgcgtagctggtggtgacatcatttatgttgaacgtttcgataaattctatatctatggtcaggttcaacgtgccagccattaccgtctcgaacatgaaatgacagtattgcaagcgctttctgtaggtggtggcttaagccctcgcggcacagaaaaaggcgtcaagatcaagcgtcgtgatgctagcggccatattgaagtaatcactgccaaacatgatgacctcatcaagcccaacgatgtgatctatgtgcaggaaagtttcttttaatagattgcagattttaataaatacttgataggcaaggttaatctaatgagcttttctcaacttttactgatattcaaagcgcgatataagatattgttaagcaccattgttgtggccctggtcgtagcaattgcgctcaatattttcttgccaaacagctataaggcaaccaccagtatcctagtcaactataaaggtgtagatcctgtgactggtatggctgtccctgcccagctgcttccaggttatatgggtacccaggtggatatcataactagcaagaaaattgctaagagggttgtgaccacattaaagctcaatgaaagtagtgaggttgtggagagtttcaatgactccacaggtggtgaaggtgatatcgttgattggttggcggatttgctgatctcacgtatcgaagttcaacctgcgcgcaacagtagtgtgttgcagctggagtttgatggagccaaccccaaatttgctgctgttgttgctaactcctttgccgaggaatatatcaaggccactatcgaactcaaggttgagccttcgaaaaaggcggctgaattttataccgggcaattgaaggatttgcgtgccgatattacccgggcgcagcaaaagctttccgattaccaacaagataaaagcatcgtcagcgttgatgagcgtctagacattgaacgtgccaagctgaatgaactttcctcgcagttagtgatgtcacaagggcaaactcttgaggcacagtctcgtcagactggtgcacaaggtagcaatgcttatggatctccggatgtcgcgagtaatccaatggttctgcacctgaaaacagagattgctaggtctgaatcacgcttcgcggatatctcacaaaaatatgagagaaatcacccactctatcagggggccaaagctgagcttgacaatctgaagtctgaattaagtaagcaaatccaggcggctaccgtcaatatatcgagcaattatagaatccttaagcaacgcgagagtgaaatccgcaatgccttggctgagcaaaaaaccaaggtcatgctgttgaacaaggatagggatgcactgacggtattgacgcgtgaagtcgagggtgcgcaacgcgcttacgaactcgcgactcagcgatatactcaaataaatcttgagggacagtctaatcaagctgatgtatccatccttaatccagcgacaccaccacttaagccatcaagcccgaaaaaaatattgaacgtggcagttgcgttggtgctgggtacaatttttggcttgttgtttagtttgttggctgagctcactaatgagcgaattcgctcagaaagagtgctggtagagattgttggcgcaccgctgctgggtgtgatcgacaaaaataaaacccattccagaattcagcgcctgctggctaaaaaaccctaatttgtgtggatatagacatgactaatgatgtttccaatactagttccattccggcattgaatgctgatttcaatatcggtggaatgttgctcaagatgggtaagattacaccgcaggatgcggagcgtatcctgcgtgtgcagaaggaaagaggcgttcgctttggtgaggctgccgagagtttgggcctagtttcctctgccgatatcaactatgtattatccaagcagtttgcctatccctacctgatggatggtcgcggcgatttctccgagaacttggtcgcggcttatgatccattcagtatcaatgtggagaagtatcgcgccattcgtagccagctcatgctctactggtttgcacaagggaaaaagagcctgtcattttccagtgtttacgacaaggacgacaccagtgacttggttgccaatcttggcgtggttttctctcaactgggagagaaaacactcatcattgatgcccatcttgatagcccacggcagaatcgcatttttaatatcaagagcactgcgggtttgtcggatattctggcaggccgggttacggattactcctcttccatcactaggctagtcgagttcgagcatctctccatcttgtcttctggcaccattccacctaatccgcgagagcttctgggacgtggtttcctcaagcagttcatcacggcaattgctaatgactacgatgttatcctggtcgatgcaccttcctttgtccgccactctgaaccgttgtctgtggcaagtgctacggaaggggtggtgcttcttgccaagcgtcatgtctccaaagccaatgacttgagcaaagtggttgatcagctttccaagatcagggtgcctgttgttggcacggtattgactgaaaactaa

SEQ ID NO: 182 - DNA, 2434 bp, Methylobacillus glycogenes
atgcttacggatgaataccgatacaagattctgaaattggtgcaggaaaaaccagatatcagccaaagagaactggcgaaagcactaggcattagcttggggaaaaccaatttttgtctcaaagccttagcgcaagttggcttgctcaaagtatctaattttcgcaacagcaagaataagttggcatatatgtatgtcctcacgccgacaggcatagaacataaagctgctgtgacactcaactttctcaaactcaagctcaaagagtacgaacaattagcaggagagattgaagagttacgtagtgagatcaacgctaaggtaaatgattaagggcggagacagttccttaggaaaaacatatgttaaaaaaagtagctctaattacaggtatcactggacaagacggagcatatctagctgaatttttacttggcaaaggctatgtagtacatggcattaagcgccgagcatcacttttcaatacagatcgcattgatcatctgtatcaggaccctcacgtcgataaccagaatttcatccttcattatggggatttgacagattccaccaaccttatacgtatcattcagcaggttcagcccgacgaaatctataacctcgcggcaatgagccacgtggcagtcagttttgaaagtcctgaatatacggctaacgcggatggtcttgggactttgcgtattctggaagctatccgcatcttggggctggaaaagaaaacccgcttttaccaagcctcgacctcagagctttatggtttggtgcaggaaacaccgcagaaagaaagcaccccattttatccacgcagcccgtatgcggttgcgaagctttatgcatattggattactgtcaattaccgcgaagcttatggcatctacgcctgtaatggtattttattcaatcacgagagccccttgcgtggggagacctttgttacccgtaaaattacccgtgccttggcgcgcatcaagctgggcttgcaagattgcctttatttgggaaatctggacgcgttgcgtgattggggtcacgccaaggattatgttgaaatgcaatggctgatgttgcaacaggaacaggcagaggatttcgtcattgcgacaggtgtgcaatacagtgtgcgcgatttcgtcaatgcagccgcccacgagctggatattgccatcacctggaaaggtcagggccaagaagagatgggatacgacggtcaaggcaggtgcattgtacaggttgacccgcgctattttaggcctaccgaagttgaaacattgcttggtgacccgagcaaggcaaagcaaaaacttggctggtcgcccagcatcagtttccaggagttggtttctgaaatggtgcgtgaagatctcaagagcgcagagcgtgacgaactggttaagcagcatggttttgctgcctatgactataacgagtaacctgagcctatggacaaacacgcacgtatctatgtggcagggcatcgaggcctagtgggttccgctatcgttagggggctagagggcaagggctatagcaatcttatcaagcgtacccatgcagagcttgacctcacagatgctaatgccacggaagcattctttgctcagtatcagccgaatatgttttcctggcggcagccaaagtgggtggcatagtggccaataacacttacccggcagattttatccgtgacaatctcgcaattcagaacagtgtgatccatagtgcctggaagcatggagtaaagcgcctattgtttttagggtccagctgcatataccccaagcatgctcctcagcccatgcatgagcaccactttctaaccggatcgcttgaagctaccaatcgtgcatacgcgctggcaaagattgctggagtcgaaatgtgctggagttataaccggcagtatggcactcgatttcttgcagcaatgccgacaaatctttatgggcctggcgataactatcacttgcagaatagtcacgttatccctgcattgatacgcaaattccacgaggctaaacaagctgggcatgcagctgtatcggtctggggtactggaacacccaggcgcgaatttctttacagtgaggatatggcagatgcctgtatattcttgctgaatctgcctgaggagaaattcaattctctgctgggaagtgatgagagtgctactggtgtgtttgatccaccactagtcaatatcggtattggagtcgatatttcaatacaggaattggccgaattggtaaaaaaggtggttggttaccaaggagcaattgagttcgatagttcaaaacctgatggcacgatgcgtaagcttatggatgtaagcaagctcaacagtttggggtggacttattccattgagcttgatgatggattggaaaagacatattcggaatttttaacaaaataa

SEQ ID NO: 183 - DNA, 4120 bp, Methylobacillus flagellatus
ttgaatactgaatatggaagcacaataatgcaatggtcgaaaatgacgaaaggggcgttggtcgccttgatgattagtatcgggctgtcgggctgtggagataaatctaatgaaacaaaggctagccaatcgctggcgagagtgaacggcaaggaaataaccgtccatcaactcaatgaagagcttgctcgggccaatgtccagccagcgcagaaagaagctgctaccaagcagatattgcaatcattgattgaccgtcaactgttggagcaggctgccttgaaagcaaaagtagaccgggacccgaacgtcatgcaagccattgagcgcgcaaaatcccaaatgattgcccaggcatacctccagtctagggtggctaacataggcaagccggacaaaacagaagttgagaatttctataagcaaaaccctcaactattttccgagcgcaagctggtggaaatggaacaaatattgattgattcacgttatgtcaatgacgaattcaagtctgcgctcggtagcttcaaaaccctgcaggaagtcgctgcgtggttggatgctaagggaatccaatatgaccgtggagaagttgcccgcagtgtggcagagctgcctccacagatttctgagcgcctgaaggatgcaaggcgtggccagctgtttgtgatcggcatgggaccgaggacgatgctggtgctcatggatagcgtaaaggagagcccggtatcactggcagatgcgacaccgcaaattgagcaaatgctcttgaataaaaagcgtaaggaagcgggtgaggctgaaatcaagcgactacgggctgaagcaaaaattgaatatttagacaaatcggccgaagtaccacaacaaccagaaaaagccgaacagtcaaaaccctctagtgtcgatgatgatattgctcgcggagtaagcggactaaagtagtaattctataaaacgtgtataggtgtagtgccatgactaaattgatcaaatggtttgtaacggtagtcctgacgattgttgtattcaatgttaacgcagcggattcggatattgttcttgggccgggggatgttctaaggatatctgtatttgaacagcctgatctttccttggaagtaagagtgagtgagtctggcactatcacctacccgttgataggcgaagtcagagtcggtggagaaacacctgcagctgctgaacgcaaaattgccagcatgctggaaagcggtggattcttgaaaaaccctcacgtgaatatcattgttgctcagttgcagagtcagcaggtttctgtgctaggtcaggttaacaggccaggtcgctacccactggatagtgcaaaatctcttgcagacgtactggcgttggccggtggagttgcacctgatgggggagatttgattagcttggttcgcaagattgaggggaaaagtgttagagagataattgattttgctgaaatgatgcgggatggcgacttaaataaaaatatcttacttacggcaggagatattatttatgtagatcgagctcctagattctatatatatggtgaggttcagcggccaggacaatatcgtcttgagtatcatatgacagtgctgcaagcactcgctgttggtggtggccttagtctcaggggaacggaaaaaggtattaaggtgaaacggttagatgatgaaggtggtgttaagataattaaagtaaagcatgatgattttattcagcctaatgatgttgtatatgtacaagagagtgtattttagtttgttttttgaataacagctgaataatcaaaaaggtaatctaagatgagttttatcagatttatttctatcattaaagctagatataaaattattatttttactttatttataacggtattaactaccgctattgttacaatattgttgccaaaaaattataaagcaacagcttcagtgcttgttaattataaaggcgctgatcctgtaacaggtgtaatgcttcctgcgcagttaatgccaggttatatggcaacgcaagtggatattatttcaagtaaaaacgttgcaaaaaaggtaattgataaactaggtctggcagatgttccagccgtaaaagaggacttttatcaagcaacttcaggtaaaggtgaaattaaagaatggcttgcagatttattgctaaaaaaacttcaagttaaaccatctcgagagagtagtattattgatattagcttttttggggtaaatccccagtttgcagctacaatcgcaaacgaatttgctgagtcttatatgcaaacttcaatacaacttaaagttgagccttctcaaaaagctgctttgtatttcgttgagcaattgaaagaactgagagaagatctagctcaagcgcaatcgaagctttcagagtatcagcaagagaaagggattgtaagtgttgatgaaagattggatgtggaaagagccagattaaatgagctttcatctcaattggttattgcacaagcacaagttatggaagcgagatctcgggaaaaaaattcaagtggaaaagaagcttatgagtctcctgatgtagcagctaatccaattatccaaaatcttaaaactgaaattgctagagcagaatcaaggtttgcagatgtttcgcagaaatttgaaagaaaccatcctttttatctaggagctaaagcagaaattgaaaatcttaagtctgagctagatagacagatcaaatcggtttcaagtaatgtggcaagtaattcaagaattctgcaacaacgtgaagcggaaatacgtttggctttaaataatcaaaaagaaaaagtattacaacttaatcgagatagggatattttatctgttttgacaagagaggttgaaaatgctcaaaaagcatacgacatggctatgcaaaggtatactcaaacgaatattgaaggtcagtcaaatcaatctgatatttctttattgaatcctgccgtggcacctcttactcccactagcccaaatttattgctgaatattatattgtcaatcctcttgggtatgtttttaggaatagggtttggagttttagctgagtttgttgatcgaagagtacggactgctgatgacttaattgaagtattacaagccccacttcttgggactattagtaaagaaaaaagaaaactgagattttttaaaaatacttcaaacctgataactttagggaaggctgaattatgatttcatttacaccttctaattcaaactctgaaaaagtagaaaatgcaccattggtaaacgaattttcagaatttacaattggtagtttattattgcggatggggaaaattacacccgaagatgctgaaagaattatgcggttacataaagagaagggtttgcgctttggagaagctgctcaagcattagggttgataactgaagatgatattcaacaggttttatcgaggcaatttaactatccttatttatcacctgaccaaaactcatatcttaatgagctcgttgctgcatatcagccttttagtaacaaagctgaggttttgagagcagtacgcagtcaattaatgctgcattggttttcaccggaacgaaaagcactagctgtttcttcagtaagcagcagcgataatgcaagctcttttgttgcaaatcttgcagttgtttttgcgcaattgggtgaaaatacattattgattgacgctaatttacgctacccacgccagcatgagatatacaatctgagtaacaaacgtgggttatctgatatcttagcaggaagagcggggtatgatgtaatttcaaaaataaatttttttgaaaacttatctgtattaactgccggtacattacctcctaatcctcaagagcttgttagcaagccaacattcggaaatttaattaaagagttggcttgtgtttatgatgtaattttattggatactcccgaacttagtaattattcagatggttatgcaattgcttttactgttggaggaattgtattagttgcaagacaaaatcatactcgagtgaatgatttatctattgctgtagaacaatgcaagaataatggtactaaggtaattgggtcaatattggttgatttgtag

SEQ ID NO: 184 - DNA, 13447 bp, Methylobacillus flagellatus
atgctgcttcctgtcattatgtctggcggggccggttccagattatggccggtttctcgtgaaactctaactaagccatttatcgaattacctgatggcagaacccttctgcagaagactttgcaacgtactgcttgcctggatggtgtgagcgaagtgctcacagtaacgaataaggaatattacttcctgacacgtgatgtctatgaggcaacagacactaatgtttcccatagctacttactagagacgatagggcgcaatactgctcctgccattgcagttgctgcactacatgccgctgcgaaacatggggaagatgtagtgctgttggtgatgccggcagatcatcttattggtaatcaaaaagttttttcaaaagcagtgactgttgcgacagatatggcggtgaatggctggatagtcacgtttggtgtagagccaagcacgcctgaaacaggttatggctacattgaaggcggagagtcaattggggactcaggcgcgcgtagagtcgttcgatttgtcgaaaagccagatttggaaactgctgagaaatatattgctttaggtcgatttacatggaatgcaggtatattctgttttactgcaaaaaccattattgctgcacttgcggagtatgttccagaagtgcttgagatagcaaaaaagaccctggcatctagtgactccaaaactgagcctgttgtattgggcgaggagcactttgcatcaagtccagatatttccatagattatgccgtcatggagcgtgcttcaaaagtggcggtagtcgcagctgattttgactggagcgacattggttcatggagcgccatggctgagttggtccagtcagatgagcgtgggaatagggtgaatggcgaagctttattggtggatgctaataattgctatatccaaagtgattcccgtcttgtggctggtataggtattgataacctgctggtggtcgatacacccgatgccctgcttgtggctcatcactccagagctcaggatgtcaaaaccgttgtgaagcaactcaagcttgagtcccatagtgcggcaaattaccatcgcaaggtacaccgtccatggggcacatacaccgtattggaagaaggcgctaattttaagatcaaatgcatcaaggtaaagcctggtgccagcctgagcttgcaaatgcaccatcatcgtagtgagcattgggttgtagtaagcggtatagctaaagttgtcaacggcgagcgcgagctgctcattaatgccaatgagtctacttacattccagcaggacacaaacaccgtcttgaaaatccaggtttgcttgacctggtgattattgaagttcaatccggggaatatttgggcgaagacgatattgttcgttttcaagatatctacggacgcacttgatgatcagcatgttaaaagccttatggctttatcgcggctttgtgttgggcagcgtcaagcgcgagtttcaatccaagtaccgtaattcgctgctaggcgcagtctggacggtcttgaaccccctcgcaatgatcgtagtgtacacagtgattttctcgcaggtaatgaaggctcgtttgcctggcgtggacagtacttttgcgtttagcattcatttatgcgctggcatactcacctggggcttgtttgctgagattgtcgggcgctcacagaccacgttcatcgataatgccaacttgctcaagaaactgagtttcccccgtctatgtctgccagtcatcgtcaccgccaccgcgctagttaactttgccattgtttttgggttgttcacagcgttcttgctgctgatcggtatgttttcgggttggccttatttggtgctgatcccggtattgatactgatgatcgtctttgctctaggcttgggtattatattgggcgttctcaatgtgtttttccgcgatgtaggtcagttctttggcattgtgcttagtttctggttttggcttacgccgattgtctatccggtcagcattcttccagaacgggtacaagattatatgcggcttaaccccatggcgcgcttgatggaggctttccaaggaatattggtacaagcaaaatggccggactggtacagtctatggccagtgtttgcgctgtctatcgtgttgtgcctgctggggctgtctttattccgcaaacatgcgggcgatatggtggatgaactttaatgggtactattgttgtcaccaacctgggtaaggcctacaagcaataccccagtcgctggtctcggttgttggagtggatagatctgaggcgtaagccgcaccaccaattgaagtggattctgcaaggagtaagttttcatatccagccaggagagacggaggcagctttgccgtgactgctgccaagcgttctaatacgagtattaagcctaaccttgcagtgatcaattggatgcttgagcaagaagaccggatgggattatctaccccaaggccttatcgtgaatttgaggagcgtgtatatcgtcatcgcgatgatctcaggcgcttaattcattcgttagtagctgacggcaaaaaaatatatgggtatggagcttctgccaaaggtaatgtagtactacaattttgtggctttacttctgaggaaatccctgccattgcagaagtaaacgaagaaaaattcggacgagtcactccgggaacgcatattcccattatttcggaaaaagaggcgcgcgctgccaagcccgactacttcttggtgcttccatggcatttcaaagatggtatcctgcgccgtgaaaaggactttctagctgatggcggcaggtttatcttcccatttcctgagatcgaaatcgtctagtttccaaaaaaagatgaaggaaaataataagataatttagacgctgttctaacgaatccattatttacataccatatatacatatacagtaagactttaaatacataaggcataatacgatgaccataaaaactgccatcattaccggcatcacaggccaagatggtgcatatctcgcagaacttctccttagtaaaggctataaggtttacggtaccttccgccgtacaagctcggtcaacttctggcgtattgaagagctgggaattgaaaatgacccaaatcttcttttggttgaatacgacctgaccgatttgtcagcaagcatccgtctattgcagagcacaggtgcaacagaagtgtacaacttagctgcgcaaagttttgtgggcgtgtcttttgagcaacctattactaccgcggagatcacaggtgtcggtgcgctcaatcttttggaggccattcgtttagtaaatcccaatattcgctattaccaagcatccacatccgaaatgttcggcaaggtgcaggcgattccacaaacggaagatacgcctttctatccacgcagtccttatggtgtcgccaagctgtatgcgcactggatgactgttaactatcgtgaaagctatggaatcttcggatctagcggtattttattcaatcatgagagtccgttgcgtggtcgcgagttcgtgacgcgcaagatcacggattcggtggccaagatcaagctggggaaacttgattgcctggagttgggtaacttggatgcaaagcgtgattggggctatgccaaggattatgtggaaggcatgtggcgcatcctgcaggcggatgagccggatacctttgtactggcgaccaatcgtaccgagactgtgcgcgattttgtaagcatggcgttcaagggggctggcattgctgttgagttcaagggcaagggcgaggacgaagttgccgtggatactgcaaccggtaagatagtggttcgggtcaatccgaagttttaccgtccagcggaagtggacctactgatcggtagcccagccaaggccaaggccaagctgggttgggaaccgaagacaacgctggagcaactctgccagatgatggtcgaggccgatctgcgccgcaacacggaaggtttctcattttgagaattctgcttactggtgctgatggattcaccgggcgccattttctgacggccgcgaaagcggccggccatgaggttgttgcactgagggccgatttgacggacaaggctgtattgcaacgcgaagttgaggcggctcgtccggaagcagtggttcatctggcagcgatcagttttgttggtcatgcggatgttagtgccttttatgacgtcaatgtgatcggtaccctgaacctgttggatgcgctggctggcttgtccgtgacgccgcgcagcgtactgctggcaagcagtgcgaatgtgtatggcaatgcagcgcattcacctatcaccgaagagcaggcgccggcgccggtcaatcactatgcaatgagcaagctggccatggagcacatggcccgtacctatctggacagactgccgttgttttttgtgcggccgttcaattacacggggccggggcaggctgagtctttcgtgattcccaagctggtggcgcatttcgcgtgcaaggcgcagaccgtggaactgggcaatctggatgtggagcgcgagttcaatgatgtggctttcgtttgcgaggcctatctgcgtttgttggacaaggctgtgccgggtgaggtgtttaatatctgcagcggtgctccggtgacattgcgtgcagtaatcgggatgttgagggaattgacggcgcatgatatcgaggtcaaggtaaatccgcagttcgtgcggaataacgagatcaagacattatgcggtgatccatcaaagctgttccgtactattggagaggggaggctggttcctttagcgcttaccttgaagatcatgctggaacacgctacgcgaaaagaaaaaaaatgatgaaggtaggttttggtgtcaccgtgcttacacgttgcctggcattggggggaatcgatggaattggtagttatacccgggagctgatgaaaagactcgaggctgacccggccgtcgagcttttccctatctcgtacgggtattctccgtcacagtttcctatcggctcacgtgctccgacgacatttggacgatatgcgccgcttgctgcagtatcggctgtatccgggtttccctttctgggaacagctcaattgaaggagcgtgttgatctgattcatgcgcctgatcatcttattcccaactacggaaaagttcctgttattgcatccatcatggacgcgattcccttgtcgcatccggagtgggtatcccccaagttgcgcaagatgaaaaatgcgttatggaagcgctctgcgcactgggcatcgcatatcattactatctctgagtattcgaagcaggaaatttcacagcatttcggtattgaggcacaaaagatcagtgccatcccgcttggcgtggatgagcggtggtttcagccgttggaagaagaggcgatgaaggtggtattgagacggtacaatctgcctcaatactattttcttgtcgtggggacgctgcagccaaggaagaatgtcggccgggtaatcgaggcatatcggtccttgccccaagggatacgtaacgaagtgccgttggtgattgttggtagggcagggtggcgatgcgaggatgtggttgaaatgttgacttcgtcttcttcaggaaattctctgaggtggctcaagcatttgccggatgccgacttgcttgcagtgttgaaaggtgcaacggctttggtctttccttcgttgtatgagggatttggtttgcccgtagtcgaagcttttgcggctggaactcccgttattacttccaataccacttctcttccagaggtggcgggcgatgccgccatgctggtgaatcctctgaatgtcagcgacattgccgctgcaatgcaatcgatgctggaacagccggaactggcagagagtttcaggaacaaggggcaagaacgcgcattggcatattcgtgggacaaaacagcctccatgacgcttgacgtctataaaaagacgcgagaggctgcttaacatcaacgcaccgtcaaacatcgcactccttccctttttatgatcatccgttttctgggcgcacagtggctcgccgttggttttgtcggggtcatctctctggcggtcagcattttgattgcgcggacgcttgggccggattcatttggtgtttattcggttgtcttgtccggcggagccattgccgccattctgcttgatggtggtttcgggcgattgttgcaaagagaacgcgcccatcccacacctgcattgctcagattcctgcccatattgccgcaggctgccttggggcatgtgattatcgcggccagcatattttcgttgatcgctttattggtactgcccaagcatgcgctgacgattgttgcggttatctggtttttcgcagcatctgtgaccaatcagttcggtttgaacattctccgcggagatgggcggatggtaagggatgcctcgtggcagatgggcaatcgaaccttcacagctgcgtgcgtgtgcattgtcattctgatgggagctgagaaaccgtggcaggtattctttgcccagtttgtcggtgcgaccgccttcggtttgctgatcatgcactatctgcgcacgcgcccgctatggaagattcctcctactctttatgcggcaaccttgccattcgtgtggttggatctcgcgacagtcctttattttcgagcggacatgctgttgctggaatggttagatgtgtccaagtttgaagtcgggaaatacggggttgcctgccgcttgattgaggcggtgattctgcttgcttcgccgctctgtattattttgttccgcaagtttcgtctgggtagcgcttctccccgactgatgttgcggagaatgctgccggtgctggcaggggcgctgatggttggagtgttcttcatggtgtttttctggttgtgcagcacgcctttgatcgcggttgcatatggcgaggcctatgcgggagctgatcatattctggcgatactcggctgcgctttgctttttattttgccaaatggcgtgctgaaccaagctgcgctagcgctgggtatcgaacgttggctggcaatgtcggcatcttttgccgcagtgctaaatattgcaggaaatctctggctgattccccaatatgggttgattggagctgcctggatgactgttgtgaccgaagcggtgttaggctgctgcgttgcgttagggctatggcgccaccgtaataggagtgtttaatgcaggatcttgccgttgctcatgtttatcgtacctattttcctgaccctccaggcgggttgcaggaggcaattcgccagattgccctcacgacgggtatgcagggcgtcgataatacggtgtttacgctttctccgcagccgcgtccggcaatcttgcagcgtccggaggcttgtgttgttcgttgccgctcctgggcggctccggcatcatgcgatctgggcggtatcggcgcatttcttgcgttttccaggttggcggaaaaatctgatgtgctacattacctttttccgtggccatttgcggatgttctgcatacggtggttcgcccaggttgtccggccgtcatgacttatatctcggacgtggtgcgtcagcagcttttagggaggttatatgctcctttgatgtggaaggtgttgcgccagatgaggcttgtggtggcgaattctccagcgtatgcacgcaccagtcccgttctctcccatcctgagattcgcgaaaaagtcagggttattccacttggtattgaggagtcttcttatcctaaatcaggggatgaggagattctgcagcgtctaggcattgggaaggatgagccttattttctttttattggcgttcttcgttattacaaaggcgcgcattttctggtcaaggcagcaaagcggataggcgcaaaggtggtgtttgctggcgcggggccggaaggcgcgcgcctgaaagcattggctggcgaagtcggtgcagagaatgtgatttttgccgggatggtgactaacgcggaaaaagtaaccttgcttcaatgctgcagagcgcttgtgttgccatcgcatttgcggtctgaagcgtacggcatggtgctggtagaggctgccatgttcgggaagccgctgatttcttgcgaaattggcacaggcacttcatatgtcaaccatcatgaagaaacagggtttgtcgttgagccggcctctcctgaagcattggcgtcggcgatggcggttttgttatcagaggataggctggctacagagatgggagctgctgctcgtcagcggtatgagctgctcttttccggcccggcattaggaaaggcatatgctgcattgttccgcgaagttgacgcttcgtagcagagtgcgtcatgatgaagtagccagagttgtaacgtttttgggattatcctgttggttttcttgattgttaatacatgatgcaattactggtgacaggcgctacagggtttgtaggtaaaactttgtgcagtgcgctaaggcggcagagcttccccgtaaaagcaattgggcgtgcgggcactatccgggctgacgctttgggtgatcaggttgcttcaattgacggtcaaacggattggtcactgatattggacggcatcaatgccgtcatccatctggcagccagggtgcacgtcatgcgggaacagcttgctgatcccttggcggcatatcgtgaaacgaatgtcgaagggacgctgaatctggcgcgtcaggcggcaaaggccggagttaagcggtttgtattcattagttccatcaaggtcaacggcgaacagactctacctggaaagccttttactgcgtacgatgtaccagctcccgaagatgcgtacggtatttcaaagttcgaggcagagcagggtttgctggccctggcgcgggagacagggatggatgtggtggttattcgccctcctttggtttacgggcctggagtgaagggtaattttgccagtatgatgaagttggtgaaaagtggaataccgttgcctctgggcgccattcataaccaacggtctttggtggcgattgataatttggtgaacctcatcgtcacgtgtattgaccatcccgcggcagccaaccaggtttttttggtaagcgatggcgaggatttgtccacttcagatttgttgcggcgtttggccaaggctgcgggcgtttcctcccgattgatgccagtgtctgcccgctggctagagatgggtttgcgtatgtgtggcaagcgattgatcgcccagcgtctcctgggatcattgcaagtcgatatttccaagacgcgcgagttgttggggtgggttccgccgatctcagtggatgagggcttgaagcgctgtttctctaccaagggctgattcttgatccgattttttgacattattttttcggtgataggcttggtactgggattcccgctattgctatcgatttataccctcggcttgtttgatacaggtgctcccttgtttcgccaggtgagggttgggcgctaccggcagccgtttactttggtgaaatttcggacgatgaaggtggatacggcttctgtggcgagccatctggcttccaccaattccatcacccggctcggacggttcttgcgcaggaccaagctggatgagctgccccagctctggaatgtcctgaagggagaaatgagcctggtggggcctcgaccgaacctgttcaatcaggaggagctgatggccgagcgcgagttgcgtggcgtttaccatgcgcggccagggattaccggccttgcacaggtgaatgatatagacatgtcgacgccaaggctgcttgccgagaccgatgccaggatgctgcgcgagatgaatgtacggctttatttcaagttgctgattcagacggtgctgggtcgaggacagggcgaccgggtcgtgcgctgagctcggcaggaaccaatgcctggctacaaagtgttgatccatgattggtcgtcactgtcccgtggtttttagtagaatgttattcattttcactttaggctgggcgcgtgctgcattatttcccctcattcaagtggtcgaactacatcagtttgaagaatccacgctctttgagcgcttggatatatgacattgttgctgctgcgctggcatggtgggcagccttcctgttacggttcaattttgatattccggccaattttgtccagagtatgctcgacagcgcagcatgggtgattccgctgcaggcatttgtgtttctgctggctgggttgtacaaaggcgtctggcgttttgccagcctgccggatttgcagcgcttggtgcgcgcgattgcgatcagcgcagtgcttgtggttgcgatcttgttcatgttcaagccacacggcattgttcctcgctcggtgctgatcttggatcctatgctgttgctgctgttgatgggcggcagccgctttgcttaccgagcatggaaagaacatcgcctgtatggttctgcccagttttccggaaagccggtgctggtgctcggcgcgggtgaggcagcgattgccttgttgaaggatctttccaaaagccgtgaatggcatgtcgttgggttgctggacgataagaaaaccatgcatggccgagagctactgggcgtcaatgtgctggggtcgattgcgcaattgccacagatcgctgcggatttgtcggtcaatcatgtgattgtggccatgccatccgcgcgtcatcaacgacgcagggaaatcgtcgagctggcaagcagaaatgggctgactgcgctcacggtgccgtcgtttgatgacctgatgagtggccacctgagcatggcacagattcggccggtcgaggtggaggacttgctggggcgggagccggtcagtctcgatggagaggggctccagcatttgatcgaggggcaggtgttgctgattactggtgcaggtggttccatcggttctgagttatgccgccaggtgctgaaataccgtccagcttgcctggtctgcctggatcagtcggagtacgcgttgtatcggttggagcaggagtttgacaatctggagtttgatacccgcattgaatacgtggttggcgatgtcaggaacgcacgccgggtggggcaggtgcttggccgttatatgcccaaactggtgttccatgctgctgcgtataagcatgtgcctttgatggagaaccgcaatgtggcggaatcattgtcaaataatgtcagcggtacttacacgctcgcccaggcatgcaaaactgcaggggttgccaagttcgtgctgatttccaccgataaggcggttaatcccaccaatgtgatgggggccagcaagcgcctggcggaaatgatatgccaaggcctgcaggaggagtcgggtacgcgttttatcgtggtgcgctttggcaatgtgctgggcagtagtggcagtgtaatccccaagttccgtgagcagattgcggcgggcgggccaattaccgttacccatcccgagatcactcgctatttcatgtccatcccggaggcgtgccagctggtcatgcaggctggattgatgggtggtggcggggagatatttgtgctggatatgggagaccctgtgcggattgtggacttggcccgtgatatgatccggttatccgggcttaatgaagatgacattcagattgtatactctggcttgcggcccggcgaaaagctgtacgaggaacttttggctgacgacgagctcactgtaccaacaccccacgacaagctacgtattgccgtggcgcgaagcgtggatggtgcttgggttcaggcattgctgaaatggatcgacagggcatcgctcatagatgaatctgtcatcaagcaagagctgggcatgtgggtggaggagtatgcaggggatattcatgccaatccatccatgatgttcccccccgagtcttcaaccatacattagaagaaagatagatagaaatggcaaaaaaaattaccaaggcagtatttccagtggcaggtttagggacacgtttcctgccagcaaccaaggcgagtcccaaggaaatgttgccaattgtggataagcctctgattcagtatgcagcagaggaggctgtggccgccggtgctaccgagctgatttttattatcgggcgcaacaagcgcaccatcccggatcattttgataagtccttcgagctggaagcgacgcttgaggcaagcaagaaaaccaaggtgctggaagaaatccgcaatatcctgccaaaaaatgtttcctgcatctatattcgccaggccgaggcgcttggtttggggcatgcggtattgcttgccaagtccgtggtcggcagcgagcctttctctgtgatcctggccgatgaccttattgatgccgacaaacctgccatgcagcagatgacagagctgttcgaccaagagggtgtcagcattctgggtgtcgaggatgtggagcccagtgagacggcaagctatggcattgtggatgcgacagaggtgagtggcccgaatgtgttgcaattgaatggcattgtggaaaaaccgcagccggaagaagcgccctccaatctggctgttgtcggtcggtatattctcacgcctgaaatttttgaatgcctggagaacgtcaagccgggcaagggcggggaaatccagttgactgatggcattgccgccttgatggaaaaacagaaaatcctggcttaccgtttcgatgggaagcgctacgattgcggcagcaagctgggttatgtcaaggcgaacgtcgagtattccttgaagcatgaggagtttggcaaagagtttgcccagtacttacgtgatctaaccaagtagcagtcgtggtggtacttgagggtaaccccgatctcattctgcagcgatccacgctggtctcttctgaagaggaagtgaagcaggcggtgacgagggtggcgcaggaaatcactgccacgctaaggcaggaccaacctctcgtcctgtgtgtcatgggaggcggggtggtattcaccgggcaattattgccacagctggttttccctttggagttcggttatgtgcaggccacccgctatcacaaccggacacatggcgatgcccagctggtgtggaaaatgaagcccggggaggaggtgcgcggccgtaccgttttattgctcgatgatattctcgatgagggggtcacgctggcagaaatcaaggcgcagtgtctggcactgggtgccagcaaggttgtcgttgcggtcttggttgaaaaaatgctggggcgggtcaagccgatcagggctgatttcgtcggactggaggtgccggaccagtatgtattcggatgcggaatggatgcctatgggtggtggcgtaatttgccggccatttatgccatgcaaggggaagcttga

The invention claimed is:

1. A genetically engineered bacterium of the genus *Methylobacillus* which has been modified to inactivate a first exopolysaccharide (EPS) gene cluster, wherein the EPS gene cluster comprises the open reading frames (ORFs) found in SEQ ID NO: 175 or 179 or ORFs orthologous to the ORFs found in SEQ ID NO: 175 or 179 wherein the genetically engineered bacterium comprises a second inactivated EPS gene cluster comprising the ORFs found in SEQ ID NO: 174 or 177 or ORFs orthologous to the ORFs found in SEQ ID NO: 174 or 177.

2. The bacterium according to claim 1, wherein at least one gene in the second EPS gene cluster is inactivated.

3. The bacterium according to claim 1, wherein the second EPS gene cluster includes the genes epsD, epsE, epsF and epsG, or orthologs thereof.

4. The bacterium according to claim 3, wherein the genes epsD, epsE, epsF and epsG, or orthologs thereof, are inactivated.

5. The bacterium according to claim 3, wherein the gene epsD encodes a polypeptide comprising an amino acid sequence having at least 70% sequence identity to SEQ ID NO: 6, wherein the gene epsE encodes a polypeptide comprising an amino acid sequence having at least 70% sequence identity to SEQ ID NO: 7, wherein the gene epsF encodes a polypeptide comprising an amino acid sequence having at least 70% sequence identity to SEQ ID NO: 8, and wherein the gene epsG encodes a polypeptide comprising an amino acid sequence having at least 70% sequence identity to SEQ ID NO: 9; or wherein the gene epsD encodes a polypeptide comprising an amino acid sequence having at least 70% sequence identity to SEQ ID NO: 42, wherein the gene epsE encodes a polypeptide comprising an amino acid sequence having at least 70% sequence identity to SEQ ID NO: 43, wherein the gene epsF encodes a polypeptide comprising an amino acid sequence having at least 70% sequence identity to SEQ ID NO: 44, and wherein the gene epsG encodes a polypeptide comprising an amino acid sequence having at least 70% sequence identity to SEQ ID NO: 45.

6. The bacterium according to claim 1, wherein the first, and/or second EPS gene cluster is inactivated by deletion of part of or the entire sequence of said cluster or by modification of the promoter and/or ribosome binding site region resulting in the lack of gene expression.

7. The bacterium according to claim 1, wherein the bacterium is *Methylobacillus* flagellatus.

8. The bacterium according to claim 1, wherein the bacterium is *Methylobacillus* glycogenes.

9. A method for the production of a biochemical compound comprising cultivating a bacterium according claim 1 under suitable culture conditions in a culture medium comprising a reduced one-carbon compound or a multi-carbon compound that contains no carbon-carbon bonds.

10. The method according to claim 9, wherein said reduced one-carbon compound is methanol.

11. The method according to claim 9, wherein said multi-carbon compound is dimethylamine.

* * * * *